United States Patent
Howard

(10) Patent No.: US 9,567,340 B2
(45) Date of Patent: Feb. 14, 2017

(54) UNSYMMETRICAL PYRROLOBENZODIAZEPINES-DIMERS FOR USE IN THE TREATMENT OF PROLIFERATIVE AND AUTOIMMUNE DISEASES

(71) Applicant: MEDIMMUNE LIMITED, Cambridge (GB)

(72) Inventor: Philip Wilson Howard, London (GB)

(73) Assignee: MEDIMMUNE LIMITED, Cambridge (GB)

( * ) Notice: Subject to any disclaimer, the term of this patent is extended or adjusted under 35 U.S.C. 154(b) by 0 days.

(21) Appl. No.: 14/654,070

(22) PCT Filed: Dec. 20, 2013

(86) PCT No.: PCT/EP2013/077695
§ 371 (c)(1),
(2) Date: Jun. 19, 2015

(87) PCT Pub. No.: WO2014/096365
PCT Pub. Date: Jun. 26, 2014

(65) Prior Publication Data
US 2015/0315196 A1   Nov. 5, 2015

Related U.S. Application Data

(60) Provisional application No. 61/740,605, filed on Dec. 21, 2012.

(51) Int. Cl.
C07D 487/04   (2006.01)
A61K 47/22   (2006.01)
C07K 5/062   (2006.01)

(52) U.S. Cl.
CPC ............. *C07D 487/04* (2013.01); *A61K 47/22* (2013.01); *C07K 5/06026* (2013.01)

(58) Field of Classification Search
CPC .................................................. C07D 487/04
See application file for complete search history.

(56) References Cited

U.S. PATENT DOCUMENTS

| | | | |
|---|---|---|---|
| 4,816,567 A | 3/1989 | Cabilly et al. |
| 5,362,852 A | 11/1994 | Geoghegan |
| 5,440,021 A | 8/1995 | Chuntharapai et al. |
| 5,583,024 A | 12/1996 | McElroy et al. |
| 5,621,002 A | 4/1997 | Bosslet et al. |
| 5,644,033 A | 7/1997 | Seon |
| 5,674,713 A | 10/1997 | McElroy et al. |
| 5,700,670 A | 12/1997 | Yamagishi et al. |
| 5,773,223 A | 6/1998 | Shyamala et al. |
| 5,792,616 A | 8/1998 | Persico et al. |
| 5,854,399 A | 12/1998 | Salomon et al. |
| 5,869,445 A | 2/1999 | Cheever et al. |
| 5,976,551 A | 11/1999 | Mottez et al. |
| 6,011,146 A | 1/2000 | Mottez et al. |
| 6,153,408 A | 11/2000 | Abastado et al. |
| 6,214,345 B1 | 4/2001 | Firestone et al. |
| 6,218,519 B1 | 4/2001 | Kenten et al. |
| 6,268,488 B1 | 7/2001 | Barbas, III et al. |
| 6,362,331 B1 | 3/2002 | Kamal |
| 6,518,404 B1 | 2/2003 | Li et al. |
| 6,534,482 B1 | 3/2003 | Fikes et al. |
| 6,555,339 B1 | 4/2003 | Liaw et al. |
| 6,562,806 B1 | 5/2003 | Thurston et al. |
| 6,602,677 B1 | 8/2003 | Wood et al. |
| 6,608,192 B1 | 8/2003 | Thurston et al. |
| 6,660,742 B2 | 12/2003 | Lee et al. |
| 6,677,435 B2 | 1/2004 | Barbas, III et al. |
| 6,747,144 B1 | 6/2004 | Thurston et al. |
| 6,759,509 B1 | 7/2004 | King et al. |
| 6,835,807 B1 | 12/2004 | Susaki et al. |
| 6,884,799 B2 | 4/2005 | Kamal |
| 6,909,006 B1 | 6/2005 | Thurston et al. |
| 7,049,311 B1 | 5/2006 | Thurston et al. |
| 7,067,511 B2 | 6/2006 | Thurston et al. |
| 7,223,837 B2 | 5/2007 | De Groot et al. |
| 7,265,105 B2 | 9/2007 | Thurston et al. |

(Continued)

FOREIGN PATENT DOCUMENTS

| | | |
|---|---|---|
| EP | 0522868 | 1/1993 |
| EP | 0875569 | 11/1998 |

(Continued)

OTHER PUBLICATIONS

Alley, M.C. et al., "SJG-136 (NSC 694501), a novel rationally designed DNA minor groove interstrand cross-linking agent with potent and broad spectrum antitumor activity. Part 2: Efficacy evaluations," Cancer Res. (2004) 64:6700-6706.

Amiel J., et al., "Heterozygous endothelin receptor B {EDNRB) mutations in isolated Hirschsprung disease," Hum. Mol. Genet. 5, 355-357, 1996.

Amir et al., "Self-Immolative Dendrimers," (2003) Angew. Chem. Int. Ed. 42:4494-4499.

Amsberry, et al, "The Lactonization of 2'-Hydroxyhydrocinnamic Acid Amides: A Potential Prodrug for Amines," (1990) J. Org. Chem. 55:5867-5877.

(Continued)

*Primary Examiner* — Bruck Kifle
(74) *Attorney, Agent, or Firm* — Michael Best & Friedrich LLP

(57) ABSTRACT

A compound of formula I:

or a pharmaceutically acceptable salt or solvate thereof.

20 Claims, No Drawings

(56) References Cited

U.S. PATENT DOCUMENTS

| | | |
|---|---|---|
| 7,375,078 B2 | 5/2008 | Feng |
| 7,407,951 B2 | 8/2008 | Thurston et al. |
| 7,429,658 B2 | 9/2008 | Howard et al. |
| 7,521,541 B2 | 4/2009 | Eigenbrot et al. |
| 7,528,126 B2 | 5/2009 | Howard et al. |
| 7,557,099 B2 | 7/2009 | Howard et al. |
| 7,612,062 B2 | 11/2009 | Gregson et al. |
| 7,704,924 B2 | 4/2010 | Thurston et al. |
| 7,723,485 B2 | 5/2010 | Junutula et al. |
| 7,741,319 B2 | 6/2010 | Howard et al. |
| 8,034,808 B2 | 10/2011 | Delavault et al. |
| 8,487,092 B2 | 7/2013 | Howard et al. |
| 8,501,934 B2 | 8/2013 | Howard et al. |
| 8,592,576 B2 | 11/2013 | Howard et al. |
| 8,633,185 B2 | 1/2014 | Howard et al. |
| 8,637,664 B2 | 1/2014 | Howard et al. |
| 8,697,688 B2 | 4/2014 | Howard et al. |
| 8,829,184 B2 | 9/2014 | Howard et al. |
| 8,940,733 B2 | 1/2015 | Howard et al. |
| 9,102,704 B2 | 8/2015 | Howard |
| 9,242,013 B2 | 1/2016 | Howard et al. |
| 2001/0055751 A1 | 12/2001 | Reiter et al. |
| 2002/0034749 A1 | 3/2002 | Billing-Medel et al. |
| 2002/0042366 A1 | 4/2002 | Thompson et al. |
| 2002/0150573 A1 | 10/2002 | Nussenzweig |
| 2002/0193567 A1 | 12/2002 | Jacobs et al. |
| 2003/0060612 A1 | 3/2003 | Goddard et al. |
| 2003/0064397 A1 | 4/2003 | Spancake et al. |
| 2003/0065143 A1 | 4/2003 | Eaton et al. |
| 2003/0091580 A1 | 5/2003 | Mitcham et al. |
| 2003/0096743 A1 | 5/2003 | Senter et al. |
| 2003/0096961 A1 | 5/2003 | Baker et al. |
| 2003/0105292 A1 | 6/2003 | Liaw et al. |
| 2003/0109676 A1 | 6/2003 | Li et al. |
| 2003/0118592 A1 | 6/2003 | Ledbetter et al. |
| 2003/0119121 A1 | 6/2003 | Baker et al. |
| 2003/0119122 A1 | 6/2003 | Baker et al. |
| 2003/0119125 A1 | 6/2003 | Baker et al. |
| 2003/0119126 A1 | 6/2003 | Baker et al. |
| 2003/0119128 A1 | 6/2003 | Baker et al. |
| 2003/0119129 A1 | 6/2003 | Baker et al. |
| 2003/0119130 A1 | 6/2003 | Baker et al. |
| 2003/0119131 A1 | 6/2003 | Baker et al. |
| 2003/0124140 A1 | 7/2003 | Bangur et al. |
| 2003/0124579 A1 | 7/2003 | Mack et al. |
| 2003/0129192 A1 | 7/2003 | Chenault et al. |
| 2003/0130189 A1 | 7/2003 | Senter et al. |
| 2003/0134790 A1 | 7/2003 | Langenfeld |
| 2003/0143557 A1 | 7/2003 | Penner |
| 2003/0157089 A1 | 8/2003 | Xu et al. |
| 2003/0165504 A1 | 9/2003 | Retter et al. |
| 2003/0185830 A1 | 10/2003 | Xu et al. |
| 2003/0186372 A1 | 10/2003 | Baker et al. |
| 2003/0186373 A1 | 10/2003 | Baker et al. |
| 2003/0194704 A1 | 10/2003 | Penn et al. |
| 2003/0195196 A1 | 10/2003 | Thurston et al. |
| 2003/0206918 A1 | 11/2003 | Fanger et al. |
| 2003/0219806 A1 | 11/2003 | Glucksmann et al. |
| 2003/0224411 A1 | 12/2003 | Stanton et al. |
| 2003/0224454 A1 | 12/2003 | Ryseck et al. |
| 2003/0228319 A1 | 12/2003 | Frantz et al. |
| 2003/0232056 A1 | 12/2003 | Fanger et al. |
| 2003/0232350 A1 | 12/2003 | Afar et al. |
| 2004/0001827 A1 | 1/2004 | Dennis |
| 2004/0005320 A1 | 1/2004 | Thompson et al. |
| 2004/0005538 A1 | 1/2004 | Chen et al. |
| 2004/0005563 A1 | 1/2004 | Mack et al. |
| 2004/0005598 A1 | 1/2004 | DeVaux et al. |
| 2004/0018194 A1 | 1/2004 | Francisco et al. |
| 2004/0018553 A1 | 1/2004 | Billing-Medel et al. |
| 2004/0022727 A1 | 2/2004 | Stanton et al. |
| 2004/0044179 A1 | 3/2004 | Baker et al. |
| 2004/0044180 A1 | 3/2004 | Baker et al. |
| 2004/0052793 A1 | 3/2004 | Carter et al. |
| 2004/0101874 A1 | 5/2004 | Ghosh et al. |
| 2004/0101899 A1 | 5/2004 | Dillon et al. |
| 2004/0121940 A1 | 6/2004 | De Groot et al. |
| 2004/0197325 A1 | 10/2004 | Law et al. |
| 2004/0198722 A1 | 10/2004 | Thurston et al. |
| 2004/0249130 A1 | 12/2004 | Stanton et al. |
| 2005/0271615 A1 | 12/2005 | Shabat et al. |
| 2006/0116422 A1 | 6/2006 | De Groot et al. |
| 2007/0154906 A1 | 7/2007 | Martin et al. |
| 2007/0191349 A1 | 8/2007 | Howard et al. |
| 2007/0249591 A1 | 10/2007 | Howard et al. |
| 2008/0090812 A1 | 4/2008 | Pepper et al. |
| 2011/0160192 A1 | 6/2011 | Howard et al. |
| 2011/0256157 A1 | 10/2011 | Howard et al. |
| 2013/0028917 A1 | 1/2013 | Howard et al. |
| 2013/0266595 A1 | 10/2013 | Flygare et al. |
| 2014/0030279 A1 | 1/2014 | Polakis et al. |
| 2014/0030280 A1 | 1/2014 | Polakis |
| 2014/0066435 A1 | 3/2014 | Howard et al. |
| 2014/0120118 A1 | 5/2014 | Howard |
| 2014/0127239 A1 | 5/2014 | Howard |
| 2014/0234346 A1 | 8/2014 | Howard et al. |
| 2014/0274907 A1 | 9/2014 | Howard et al. |
| 2014/0286970 A1 | 9/2014 | Jeffrey et al. |
| 2014/0294868 A1 | 10/2014 | Howard et al. |
| 2014/0302066 A1 | 10/2014 | Jeffrey et al. |
| 2015/0111880 A1 | 4/2015 | Howard et al. |
| 2015/0126495 A1 | 5/2015 | Howard et al. |
| 2015/0133435 A1 | 5/2015 | Howard et al. |
| 2015/0158869 A1 | 6/2015 | Howard |
| 2015/0183883 A1 | 7/2015 | Asundi |
| 2015/0265722 A1 | 9/2015 | Van Berkel |
| 2015/0273077 A1 | 10/2015 | Van Berkel |
| 2015/0273078 A1 | 10/2015 | Van Berkel |
| 2015/0274737 A1 | 10/2015 | Howard et al. |
| 2015/0283258 A1 | 10/2015 | Van Berkel |
| 2015/0283262 A1 | 10/2015 | Van Berkel |
| 2015/0283263 A1 | 10/2015 | Van Berkel |
| 2015/0297746 A1 | 10/2015 | Van Berkel |
| 2015/0315196 A1 | 11/2015 | Howard et al. |
| 2015/0344482 A1 | 12/2015 | Howard |
| 2016/0015828 A1 | 1/2016 | Torgor |
| 2016/0031887 A1 | 2/2016 | Howard et al. |

FOREIGN PATENT DOCUMENTS

| | | |
|---|---|---|
| EP | 1295944 | 3/2003 |
| EP | 1347046 | 9/2003 |
| EP | 1394274 | 3/2004 |
| EP | 1439393 | 7/2004 |
| JP | 58-180487 | 10/1983 |
| JP | 05003790 | 1/1993 |
| JP | 2004113151 | 4/2004 |
| WO | WO 91/02536 | 3/1991 |
| WO | WO 92/07574 | 5/1992 |
| WO | WO 92/17497 | 10/1992 |
| WO | WO 94/10312 | 5/1994 |
| WO | WO 94/28931 | 12/1994 |
| WO | WO 96/30514 | 10/1996 |
| WO | WO 97/07198 | 2/1997 |
| WO | WO 97/44452 | 11/1997 |
| WO | WO 98/13059 | 4/1998 |
| WO | WO 98/37193 | 8/1998 |
| WO | WO 98/40403 | 9/1998 |
| WO | WO 98/51805 | 11/1998 |
| WO | WO 98/51824 | 11/1998 |
| WO | WO 99/28468 | 6/1999 |
| WO | WO 99/46284 | 9/1999 |
| WO | WO 99/58658 | 11/1999 |
| WO | WO 00/12130 | 3/2000 |
| WO | WO 00/12506 | 3/2000 |
| WO | WO 00/12507 | 3/2000 |
| WO | WO 00/12508 | 3/2000 |
| WO | WO 00/12509 | 3/2000 |
| WO | WO 00/14228 | 3/2000 |
| WO | WO 00/20579 | 4/2000 |
| WO | WO 00/22129 | 4/2000 |
| WO | WO 00/32752 | 6/2000 |
| WO | WO 00/36107 | 6/2000 |
| WO | WO 00/40614 | 7/2000 |

(56) References Cited

FOREIGN PATENT DOCUMENTS

| | | |
|---|---|---|
| WO | WO 00/44899 | 8/2000 |
| WO | WO 00/53216 | 9/2000 |
| WO | WO 00/55351 | 9/2000 |
| WO | WO 00/75655 | 12/2000 |
| WO | WO 01/00244 | 1/2001 |
| WO | WO 01/16104 | 3/2001 |
| WO | WO 01/16318 | 3/2001 |
| WO | WO 01/38490 | 5/2001 |
| WO | WO 01/40269 | 6/2001 |
| WO | WO 01/40309 | 6/2001 |
| WO | WO 01/41787 | 6/2001 |
| WO | WO 01/45746 | 6/2001 |
| WO | WO 01/46232 | 6/2001 |
| WO | WO 01/46261 | 6/2001 |
| WO | WO 01/48204 | 7/2001 |
| WO | WO 01/53463 | 7/2001 |
| WO | WO 01/57188 | 8/2001 |
| WO | WO 01/62794 | 8/2001 |
| WO | WO 01/66689 | 9/2001 |
| WO | WO 01/72830 | 10/2001 |
| WO | WO 01/72962 | 10/2001 |
| WO | WO 01/75177 | 10/2001 |
| WO | WO 01/77172 | 10/2001 |
| WO | WO 01/88133 | 11/2001 |
| WO | WO 01/90304 | 11/2001 |
| WO | WO 01/94641 | 12/2001 |
| WO | WO 01/98351 | 12/2001 |
| WO | WO 02/02587 | 1/2002 |
| WO | WO 02/02624 | 1/2002 |
| WO | WO 02/06317 | 1/2002 |
| WO | WO 02/06339 | 1/2002 |
| WO | WO 02/10187 | 2/2002 |
| WO | WO 02/10382 | 2/2002 |
| WO | WO 02/12341 | 2/2002 |
| WO | WO 02/13847 | 2/2002 |
| WO | WO 02/14503 | 2/2002 |
| WO | WO 02/16413 | 2/2002 |
| WO | WO 02/22153 | 3/2002 |
| WO | WO 02/22636 | 3/2002 |
| WO | WO 02/22660 | 3/2002 |
| WO | WO 02/22808 | 3/2002 |
| WO | WO 02/24909 | 3/2002 |
| WO | WO 02/26822 | 4/2002 |
| WO | WO 02/30268 | 4/2002 |
| WO | WO 02/38766 | 5/2002 |
| WO | WO 02/054940 | 7/2002 |
| WO | WO 02/059377 | 8/2002 |
| WO | WO 02/060317 | 8/2002 |
| WO | WO 02/061087 | 8/2002 |
| WO | WO 02/064798 | 8/2002 |
| WO | WO 02/071928 | 9/2002 |
| WO | WO 02/072596 | 9/2002 |
| WO | WO 02/078524 | 10/2002 |
| WO | WO 02/081646 | 10/2002 |
| WO | WO 02/083866 | 10/2002 |
| WO | WO 02/086443 | 10/2002 |
| WO | WO 02/088170 | 11/2002 |
| WO | WO 02/088172 | 11/2002 |
| WO | WO 02/089747 | 11/2002 |
| WO | WO 02/092836 | 11/2002 |
| WO | WO 02/094852 | 11/2002 |
| WO | WO 02/098358 | 12/2002 |
| WO | WO 02/099074 | 12/2002 |
| WO | WO 02/099122 | 12/2002 |
| WO | WO 02/101075 | 12/2002 |
| WO | WO 02/102235 | 12/2002 |
| WO | WO 02/16429 | 1/2003 |
| WO | WO 03/000842 | 1/2003 |
| WO | WO 03/002717 | 1/2003 |
| WO | WO 03/003906 | 1/2003 |
| WO | WO 03/003984 | 1/2003 |
| WO | WO 03/004529 | 1/2003 |
| WO | WO 03/004989 | 1/2003 |
| WO | WO 03/008537 | 1/2003 |
| WO | WO 03/009814 | 2/2003 |
| WO | WO 03/014294 | 2/2003 |
| WO | WO 03/016475 | 2/2003 |
| WO | WO 03/016494 | 2/2003 |
| WO | WO 03/018621 | 3/2003 |
| WO | WO 03/022995 | 3/2003 |
| WO | WO 03/023013 | 3/2003 |
| WO | WO 03/024392 | 3/2003 |
| WO | WO 03/025138 | 3/2003 |
| WO | WO 03/025148 | 3/2003 |
| WO | WO 03/025228 | 3/2003 |
| WO | WO 03/026493 | 4/2003 |
| WO | WO 03/026577 | 4/2003 |
| WO | WO 03/029262 | 4/2003 |
| WO | WO 03/029277 | 4/2003 |
| WO | WO 03/029421 | 4/2003 |
| WO | WO 03/034984 | 5/2003 |
| WO | WO 03/035846 | 5/2003 |
| WO | WO 03/042661 | 5/2003 |
| WO | WO 03/043583 | 5/2003 |
| WO | WO 03/045422 | 6/2003 |
| WO | WO 03/048202 | 6/2003 |
| WO | WO 03/054152 | 7/2003 |
| WO | WO 03/055439 | 7/2003 |
| WO | WO 03/055443 | 7/2003 |
| WO | WO 03/062401 | 7/2003 |
| WO | WO 03/072035 | 9/2003 |
| WO | WO 03/072036 | 9/2003 |
| WO | WO 03/077836 | 9/2003 |
| WO | WO 03/081210 | 10/2003 |
| WO | WO 03/083041 | 10/2003 |
| WO | WO 03/083047 | 10/2003 |
| WO | WO 03/083074 | 10/2003 |
| WO | WO 03/087306 | 10/2003 |
| WO | WO 03/087768 | 10/2003 |
| WO | WO 03/088808 | 10/2003 |
| WO | WO 03/089624 | 10/2003 |
| WO | WO 03/089904 | 10/2003 |
| WO | WO 03/093444 | 11/2003 |
| WO | WO 03/097803 | 11/2003 |
| WO | WO 03/101283 | 12/2003 |
| WO | WO 03/101400 | 12/2003 |
| WO | WO 03/104270 | 12/2003 |
| WO | WO 03/104275 | 12/2003 |
| WO | WO 03/104399 | 12/2003 |
| WO | WO 03/105758 | 12/2003 |
| WO | WO 04/000221 | 12/2003 |
| WO | WO 04/000997 | 12/2003 |
| WO | WO 04/001004 | 12/2003 |
| WO | WO 2004/009622 | 1/2004 |
| WO | WO 2004/011611 | 2/2004 |
| WO | WO 2004/015426 | 2/2004 |
| WO | WO 2004/016225 | 2/2004 |
| WO | WO 2004/020583 | 3/2004 |
| WO | WO 2004/020595 | 3/2004 |
| WO | WO 2004/022709 | 3/2004 |
| WO | WO 2004/022778 | 3/2004 |
| WO | WO 2004/027049 | 4/2004 |
| WO | WO 2004/031238 | 4/2004 |
| WO | WO 2004/032828 | 4/2004 |
| WO | WO 2004/032842 | 4/2004 |
| WO | WO 2004/040000 | 5/2004 |
| WO | WO 2004/042346 | 5/2004 |
| WO | WO 2004/043361 | 5/2004 |
| WO | WO 2004/043963 | 5/2004 |
| WO | WO 2004/044178 | 5/2004 |
| WO | WO 2004/045516 | 6/2004 |
| WO | WO 2004/045520 | 6/2004 |
| WO | WO 2004/045553 | 6/2004 |
| WO | WO 2004/046342 | 6/2004 |
| WO | WO 2004/047749 | 6/2004 |
| WO | WO 2004/048938 | 6/2004 |
| WO | WO 2004/053079 | 6/2004 |
| WO | WO 2004/058309 | 7/2004 |
| WO | WO 2004/063355 | 7/2004 |
| WO | WO 2004/063362 | 7/2004 |
| WO | WO 2004/063709 | 7/2004 |
| WO | WO 2004/065576 | 8/2004 |
| WO | WO 2004/065577 | 8/2004 |
| WO | WO 2004/074320 | 9/2004 |

(56) References Cited

FOREIGN PATENT DOCUMENTS

| WO | WO 2005/023814 | 3/2005 |
|---|---|---|
| WO | WO 2005/042535 | 5/2005 |
| WO | WO 2005/082023 | 9/2005 |
| WO | WO 2005/085177 | 9/2005 |
| WO | WO 2005/085250 | 9/2005 |
| WO | WO 2005/085251 | 9/2005 |
| WO | WO 2005/085259 | 9/2005 |
| WO | WO 2005/085260 | 9/2005 |
| WO | WO 2005/105113 | 11/2005 |
| WO | WO 2005/110423 | 11/2005 |
| WO | WO 2006/111759 | 10/2006 |
| WO | WO 2007/039752 | 4/2007 |
| WO | WO 2007/044515 | 4/2007 |
| WO | WO 2007/085930 | 8/2007 |
| WO | WO 2008/050140 | 5/2008 |
| WO | WO 2009/052249 | 4/2009 |
| WO | WO 2009/060208 | 5/2009 |
| WO | WO 2009/060215 | 5/2009 |
| WO | WO 2010/010347 | 1/2010 |
| WO | WO 2010/043877 | 4/2010 |
| WO | WO 2010/043880 | 4/2010 |
| WO | WO 2010/091150 | 8/2010 |
| WO | WO 2011/128650 | 10/2011 |
| WO | WO 2011/130598 | 10/2011 |
| WO | WO 2011/130613 | 10/2011 |
| WO | WO 2011/130616 | 10/2011 |
| WO | WO 2012/112708 | 8/2012 |
| WO | WO 2013/041606 | 3/2013 |
| WO | WO 2013/053871 | 4/2013 |
| WO | WO 2013/053872 | 4/2013 |
| WO | WO 2013/053873 | 4/2013 |
| WO | WO 2013/055987 | 4/2013 |
| WO | WO 2013/055990 | 4/2013 |
| WO | WO 2013/055993 | 4/2013 |
| WO | WO 2013/164592 | 11/2013 |
| WO | WO 2013/164593 | 11/2013 |
| WO | WO 2013/177481 | 11/2013 |
| WO | WO 2014/011518 | 1/2014 |
| WO | WO 2014/011519 | 1/2014 |
| WO | WO 2014/057072 | 4/2014 |
| WO | WO 2014/057073 | 4/2014 |
| WO | WO 2014/057074 | 4/2014 |
| WO | WO 2014/057113 | 4/2014 |
| WO | WO 2014/057114 | 4/2014 |
| WO | WO 2014/057115 | 4/2014 |
| WO | WO 2014/057117 | 4/2014 |
| WO | WO 2014/057118 | 4/2014 |
| WO | WO 2014/057119 | 4/2014 |
| WO | WO 2014/057120 | 4/2014 |
| WO | WO 2014/057122 | 4/2014 |
| WO | WO 2014/022679 | 6/2014 |
| WO | WO 2014/096365 | 6/2014 |
| WO | WO 2014/096368 | 6/2014 |
| WO | WO 2014/130879 | 8/2014 |
| WO | WO 2014/140174 | 9/2014 |
| WO | WO 2014/140862 | 9/2014 |
| WO | WO 2014/159981 | 10/2014 |
| WO | WO 2014/174111 | 10/2014 |
| WO | WO 2015/052321 | 4/2015 |
| WO | WO 2015/052322 | 4/2015 |
| WO | WO 2015/052532 | 4/2015 |
| WO | WO 2015/052533 | 4/2015 |
| WO | WO 2015/052534 | 4/2015 |
| WO | WO 2015/052535 | 4/2015 |
| WO | WO 2015/095124 | 6/2015 |
| WO | WO 2015/159076 | 10/2015 |

OTHER PUBLICATIONS

Arai H., et al., "Molecular cloning of human endothelin receptors and their expressiOn in vascular endothelial cells and smooth muscle cells," Jpn. Circ. J. 56, 1303-1307, 1992.

Arai H., et al., "The Human Endotbelin-B Receptor Gene. Structural Organization and Chromosomal Assignment," J. Biol. Chem. 268, 3463-3470, 1993.

Arima et al., "Studies on Tomaymycin, a New Antibiotic. I. Isolation and Properties of Tomaymycin," J. Antibiotics (1972) 25:437-444.

Attie T., et al., "Mutation of the endothelin-receptor B gene in Waardenburg-Hirschsprung disease," Hum. Mol. Genet. 4, 2407-2409, 1995.

Auricchio A., et al., "Endothelin-B receptor mutations in patients with isolated Hirschsprung disease from a non-inbred population," Hum. Mol. Genet. 5:351-354, 1996.

Barel M., et al., "Evidence for a new transcript of the Epstein-Barr virus/C3d receptor (CR2, CD21) which is due to alternative exon usage," Mol. Immunol. 35, 1025-1031, 1998.

Barella et al., "Sequence variation of a novel heptahelical leucocyte receptor through alternative transcript formation," (1995) Biochem. J. 309:773-779.

Barnett T., et al., "Carcinoembryonic Antigen Family. Characterization of cDNAs Coding for NCA and CEA and Suggestion of Nonrandom Sequence Variation in Their Conserved Loop-Domains," Genomics 3, 59-66, 1988.

Beck et al., "DNA Sequence Analysis of 66 kb of the Human MHC Class II Region Encoding a Cluster of Genes for Antigen Processing," (1992) J. Mol. Biol. 228:433-441.

Beck et al., "Evolutionary Dynamics of Non-coding Sequences Within the Class II Region of the Human MHC," (1996) J. Mol. Biol. 25 255:1-13.

Berge et al., "Pharmaceutical Salts," J. Pharm. Sci. (1977) 66:1-19.

Blumberg H., et al., "Interleukin 20: Discovery, Receptor Identification, and Role in Epidermal Function," Cell 104, 9-19, 2001.

Bose et al., "New Approaches to Pyrrolo [2,1-c][1,4]benzodiazepines: Synthesis, DNA-binding and cytotoxicity of DC-81," Tetrahedron, 48, 751-758 (1992).

Bose, D.S. et al., "Rational Design of a Highly Efficient Irreversible DNA Interstrand Cross-Linking Agent Based on the Pyrrolobenzodiazepine Ring System," J. Am. Chem. Soc., 114, 4939-4941 (1992).

Bourgeois C., et al., "Endothelin-1 and ETA Receptor Expression in Vascular Smooth Muscle Cells from Human Placenta: A New ETA Receptor Messenger Ribonucleic Acid is Generated by Alternative Splicing of Exon 3," J. Clin. Endocrinol. Metab. 82, 3116-3123, 1997.

Brinster et al., "Introits increase transcriptional efficiency in transgenic mice," (1988) Proc. Natl. Acad. Sci. USA 85:836-840.

Buchman and Berg "Comparison of Intron-Dependent and Intron-Independent Gene Expression," (1988) Mol. Cell. Biol. 8:4395.

Carl et al., "A Novel Connector Linkage Applicable in Prodrug Design," (1981) J. Med. Chem. 24:479-480.

Carlsson et al., "Protein Thiolation and Reversible Protein-Protein Conjugation," (1978) Biochem. J. 173:723-737.

Carter, P., "Potent antibody therapeutics by design," (2006) Nature Reviews Immunology 6:343-357.

CellTiter-Glo Luminescent Cell Viability Assay, Promega Corp. Technical Bulletin TB288, dated Jan. 13, 2012 (14 pages).

Chakravarty et al., "Plasmin-Activated Prodrugs for Cancer Chemotherapy. 2. Synthesis and Biological Activity of Peptidyl Derivatives of Doxorubicin," (1983) J. Med. Chem. 26:638-644.

Chan, J and Watt, V.M., "eek and erk, new members of the eph subclass of receptor protein-tyrosine kinases," Oncogene 6 (6), 1057-1061 (1991).

Chang et al., "Molecular cloning of mesothelin, a differentiation antigen present on mesothelium, mesotheliomas, and ovarian cancers," Proc. Natl. Acad. Sci. U.S.A. 93 (1):136-140 (1996).

Child et al., "Translational Control by an Upstream Open Reading Frame in the HER-2/neu Transcript," (1999) J. Biol. Chem. 274:24335-24341.

Cho et al., "Structure of the extracellular region of HER2 alone and in complex with the Herceptin Fab," Nature 421, 756-760, 2003.

Ciccodicola, A., et al., "Molecular characterization of a gene of the 'EGF family' expressed in undifferentiated human NTERA2 teratocarcinoma cells," EMBO J. 8 (7):1987-1991 (1989).

Clackson et al., "Making antibody fragments using phage display libraries," (1991) Nature, 352:624-628.

(56) References Cited

OTHER PUBLICATIONS

Clark H.F., et al., "The Secreted Protein Discovery Initiative (SPDI], a Large-Scale Effort to Identify Novel Human Secreted and Transmembrane Proteins: A Bioinformatics Assessment," Genome Res. 13, 2265-2270, 2003.
Corey E. Quinn JE, Buhler KR, et al., "LuCap35: a new model of prostate cancer progression to androgen independence." The Prostate 2003;55:239-46.
Coussens L., et al., "Tyrosine Kinase Receptor with Extensive Homology to EGF Receptor Shares Chromosomal Location With neu Oncogene," Science (1985) 230(4730):1132-1139.
Cragg et al., "The alternative transcript of CD79b is overexpressed in B-CLL and inhibits signaling for apoptosis," Blood (2002) 100 (9):3068-3076.
Cree et al., "Methotrexate chemosensitivity by ATP luminescence in human leukemia cell lines and in breast cancer primary cultures: comparison of the TCA-100 assay with a clonogenic assay," (1995) AntiCancer Drugs 6:398-404.
Crouch et al., "The use • of ATP bioluminescence as a measure of cell proliferation and cytotoxicity," (1993) J. Immunol. Meth. 160:81-88.
Davis et al., "Identification of a family of Fe receptor homo logs with preferential B cell expression," (2001) Proc. Natl. Acad. Sci. USA 98(17):9772-9777.
de Groot et al., ""Cascade-Release Dendrimers" Liberate All End Groups upon a Single Triggering Event in the Dendritic Core," (2003) Angew. Chem. Int. Ed. 42:4490-4494.
de Groot et al., "Elongated Multiple Electronic Cascade and Cyclization Spacer Systems in Activatible Anticancer Prodrug for Enhanced Drug Release," (2001) J. Org. Chem. 66:8815-8830.
Dennis et al., (2002) "Albumin Binding as a General Strategy for Improving the Pharmacokinetics of Proteins" J Biol Chem. 277:35035-35043.
Dijke, P., et al., "Characterization of Type I Receptors for Transforming Growth Factor-beta and Activin," Science 264 (5155):101-104 (1994).
Dobner et al., "Differentiation-specific expression of a novel G protein-coupled receptor from Burkitt's lymphoma," (1992) Eur. J. Immunol. 22:2795-2799.
Dono et al., "Isolation and Characterization of the CRI PTO Autosomal Gene and Its X-linked Related Sequence," Am. J. Hum. Genet. 49:555-565, 1991.
Dornan et al., "Therapeutic potential of an anti -CD79b antibody-drug conjugate, anti-CD79b-vc-MMAE, for the treatment of non-Hodgkin lymphoma," (2009) Blood 114(13):2721-2729.
Doronina et al., "Enhanced Activity of Monomethylauristatin F through Monoclonal Antibody Delivery: Effects of Linker Technology on Efficacy and Toxicity," (2006) Bioconj. Chem. 17:114-124.
Dubowchik et al., "Cathepsin B-Labile Dipeptide Linkers for Lysosomal Release of Doxorubicin from Internalizing Immunoconjugates: Model Studies of Enzymatic Drug Release and Antigen-Specific In Vitro Anticancer Activity," Bioconjugate Chem. (2002) 13, 855-869.
Dubowchik, et al., "Monomethoxytrityl (MMT) as a Versatile Amino Protecting Group for Complex Prodrugs of Anticancer Compounds Sensitive to Strong Acids, Bases and Nucleophiles," (1997) Tetrahedron Letters. 38:5257-5260.
Dumoutier L., et al., "Cutting Edge: STAT Activation by IL-19, IL-20 and mda-7 Through IL-20 Receptor Complexes of Two Types," J. Immunol. 167, 3545-3549, 2001.
Ehsani A., et al., "Characterization of a New Allele of the Human ERBB2 Gene by Allele-Specific Competition Hybridization," (1993) Genomics 15, 426-429.
Elshourbagy N.A., et al., "Molecular Characterization and Regulation of the Human Endothelin Receptors," J. Biol. Chem. 268, 3873-3879, 1993.
Erickson et al., "Antibody-Maytansinoid Conjugates are Activated in Targeted Cancer Cells by Lysosomal Degradation and Linker-Dependent Intracellular Processing," (2006) Cancer Res. 66(8): 4426-4433.

Feild, J.A., et al., "Cloning and Functional Characterization of a Sodium-Dependent Phosphate Transporter Expressed in Human Lung and Small Intestine," (1999) Biochem. Biophys. Res. Commun. 258 (3):578-582.
Fields, G. and Noble, R. (1990) "Solid phase peptide synthesis utilizing 9-fluoroenylmethoxycarbonyl amino acids", Int. J. Peptide Protein Res. 35:161-214.
Flanagan et al., "The Ephrins and EPH Receptors in Neural Development," Annu. Rev. Neurosci. 21:309-345 (1998).
Fox et al., "cDNA cloning and tissue distribution of five human EPH-like receptor protein-tyrosine kinases," Oncogene 10 (5):897-905 (1995).
Fuchs S., et al., "Functional Characterization of Three Mutations of the Endothelin B Receptor Gene in Patients With Hirschsprung's Disease: Evidence for Selective Loss of Gi Coupling," Mol. Med. 7, 115-124, 2001.
Fujisaku et al., "Genomic Organization and Polymorphisms of the Human C3d/Epstein-Barr Virus Receptor," (1989) J. Biol. Chem. 264 (4):2118-2125.
Gary S.C., et al., "cDNA cloning chromosomal localization, and expression analysis of human BEHAB/brevican, a brain specific proteoglycan regulated during cortical development and in glioma," Gene 256, 139-147, 2000.
Gaugitsch, H.W., et al., "A Novel Transiently Expressed, Integral Membrane Protein Linked to Cell Activation. Molecular Cloning Via the Rapid Degradation Signal AUUUA," (1992) J. Biol. Chem. 267 (16):11267-11273.
Geiser et al "Automation of solid-phase peptide synthesis" in Macromolecular Sequencing and Synthesis, Alan R. Liss, Inc., 1988, pp. 199-218.
Geoghegan & Stroh, "Site-Directed Conjugation of Nonpeptide Groups to Peptides and Proteins via Periodate Oxidation of a 2-Amino Alcohol. Application to Modification at N-Terminal Serine," (1992) Bioconjugate Chern. 3:138-146.
Getz et al., "A Comparison between the Sulfhydryl Reductants Tris(2-carboxyethyl)phosphine and Dithiothreitol for Use in Protein Biochemistry," (1999) Anal. Biochem. vol. 273:73-80.
Glynne-Jones et al., "TENB2, A Proteogl YCAN Identified in Prostate Cancer That is Associated With Disease Progression and Androgen Independence," (2001) Int J Cancer. Oct. 15; 94(2): 178-184.
Gordon et al., "Somatic hypermutation of the B cell receptor genes 829 (lgf3, CD79b) and mb1 (lga, CD79a)," PNAS, Apr. 1, 2003, vol. 100, No. 7, 4126-4131.
Gregson, S. et al., "Synthesis of a novel C2/C2'-exo unsaturated pyrrolobenzodiazepine cross-linking agent with remarkable DNA binding affinity and cytotoxicity," Chemical Communications, 797-798 (1999).
Gregson, S.J. et al., "Linker length modulates DNA cross-linking reactivity and cytotoxic potency of C8/C8' ether-linked C2-exo-unsaturated pyrrolo [2,1-c] [1,4]benzodiazepine (PBD) dimers," J. Med. Chem. (2004) 1161-1174.
Gregson, S.J. et al., "Design, Synthesis and Evaluation of a Novel Pyrrolobenzodiazepine DNA-Interactive Agent with Highly Efficient Cross-Linking Ability and Potent Cytotoxicity", J. Med. Chem., 44: 737-748 (2001).
Gu Z., et al., "Prostate stem cell antigen (PSCA) expression increases with high gleason score, advanced stage and bone metastasis in prostate cancer," Oncogene 19, 1288-1296, 2000.
Guselnikov et al., "A family of highly diverse human and mouse genes structurally links leukocyte FcR, gp42 and PECAM-1," Immunogenetics 54 (2):87-95 (2002).
Ha et al., "Molecular Cloning and Expression Pattern of a Human Gene Homologous to the Murine mb-1 Gene," (1992) J. Immunol. 148(5):1526-1531.
Haendler B., et al., "Molecular Cloning of Human Endothelin (ET) Receptors ETA and ETB," J. Cardiovasc. Pharmacal. 20, s1-S4, 1992.
Hamblett et al., "Effects of Drug Loading on the Antitumor Activity of a Monoclonal Antibody Drug Conjugate," (2004) Clin. Cancer Res. 10:7063-7070.

(56) References Cited

OTHER PUBLICATIONS

Hara et al., "DC 102, a new glycosidic pyrrolo(1,4)benzodiazepine antibiotic produced by *Streptomyces* sp.", J. Antibiotics, 41, 702-704 (1988).
Hartley, J.A. et al., "SJG-136 (NSC 694501), a novel rationally designed DNA minor groove interstrand crosslinking agent with potent and broad spectrum antitumor activity. Part 1: Cellular pharmacology, in vitro and initial in vivo antitumor activity," Cancer Res. (2004) 64:6693-6699.
Hashimoto et al., "Chromosomal localization, genomic structure, and allelic polymorphism of the human CD79a (lg-alpha/nib-1) gene," (1994) Immunogenetics 40(4 ):287-295.
Hay et al., "A 2-Nitroimidazole Carbamate Prodrug of 5-Amin0-1-(Chloromethyl)-3-[(5,6,7-Trimethoxyindol-2-YL)Carbonyl]-1,2-Dihydr0-3H -Benz[E]Indole (Amino-Seco-CBI-TMI) for Use With Adept and Gdept," (1999) Bioorg. Med. Chem. Lett. 9:2237-2242.
Herdwijn et al., "Synthesis of trans(+)6-phenoxyacetamido-l-methylene-3,3-dicarboxymethyl-l-cathapenam," Canadian Journal of Chemistry. 1982, 60, 2903-2907.
Hermanson, G.T., "Heterobifunctional Cross-linkers," (1996) Bioconjugate Techniques; Academic Press: New York, p. 234-242.
Hochlowski, J. et al., "Abbeymycin, a new anthramycin-type antibiotic produced by a streptomycete," J. Antibiotics, 40, 145-148 (1987).
Hofstra R.M.W., et al., "A homozygous mUtation in the endothelin-3 gene associated with a combined Waardenburg type 2 and Hirschsprung phenotype (Shah-Waardenburg syndrome)," Eur. J. Hum. Genet. 5, 180-185, 1997.
Hofstra R.M.W., et al., "Mutations in Hirschsprung Disease: When Does a Mutation Contribute to the Phenotype," Nat. Genet. 12, 445-447, 1996.
Horie et al., "Identification and Characterization of TMEFF2, a Novel Surviv Factor for Hippocampal and Mesencephalic Neurons," (2000) Genornics 67: 146-152.
Howard, P.W. et al., "Synthesis of a novel C2/C2'-aryl-substituted pyrrolo[2,1-c][1,4]benzodiazepine dimer prodrug with improved water solubility and reduced DNA reaction rate," Bioorg. Med. Chem., Sep. 2009, In Press, 4 pages now: Sep. 2009, 19:6463-6466.
Hubert, R.S., et al., "STEAP: A prostate-specific cell-surface antigen highly expressed in human prostate tumors," (1999) Proc. Natl. Acad. Sci. U.S.A. 96 (25):14523-14528.
Hurley, L. and Needham-Vandevanier, D., "Covalent Binding of Antitumor Antibiotics in the Minor Groove of DNA. Mechanism of Action of CC-1065 and the Pyrrolo(1,4)benzodiazepines," Acc. Chem. Res., 19, 230-237 (1986).
Ide et al., "Cloning of human bone morphogenetic protein type IB receptor (BMPRIB) and its expression in prostate cancer in comparison with other BMPRs," Oncogene (1997) 14, 1377-1382.
Itoh et al., "Sibanomicin, a new pyrrolo(1,4)benzodiazepine antitumor antibiotic produced by a *Micromonospora* sp." J. Antibiotics, 41, 1281-1284 (1988).
Jeffrey, S.C., "Design, synthesis, and in vitro evaluation of dipeptide-based antibody minor groove binder conjugates," J. Med. Chem. (2005) 48(5):1344-1358.
Jonsson et al., "Human class II DNA and DOB genes display low sequence variability," (1989) Immunogenetics 29(6):411-413.
Junutula, et al., "Site-specific conjugation of a cytotoxic drug to an antibody improves the therapeutic index," 2008b Nature Biotech., 26(8):925-932.
Kamal et al., "Pyrrolo [2,1-c] [1,4]benzodiazepine-β-glucuronide prodrugs with a potential for selective therapy of solid tumors by PMT and ADEPT strategies," Bioorg & Med Chem Lett., 18(13), 2008, 3769-3773.
Kamal et al., Bioorg. Med Chem., 12(2004), 5427-5436.
Kamal, A. et al., "Design, synthesis and evaluation of new noncrosslinking pyrrolobenzodiazepine dimers with efficient DNA binding ability and potent antitumor activity," J. Med. Chem. (2002) 45:4679-4688.
Kang, G.-D. et al., "Synthesis of a novel C2-aryl substituted 1,2-unsaturated pyrrolobenzodiazepine," Chem. Commun. (2003) 1688-1689.
Kasahara et al., "Nucleotide sequence of a chimpanzee DOB eDNA clone," (1989) Immunogenetics 30(1):66-68.
King et al., "Facile synthesis of maleimide bifunctional Jinkers," (2002) Tetrahedron Letters 43:1987-1990.
Kingsbury et al., "A Novel Peptide Delivery System Involving Peptidase Activated Prodrugs as Antimicrobial Agents. Synthesis and Biological Activity of Peptidyl Derivatives of 5 Fluorouracil," (1984) J. Med. Chem. 27:1447-1451.
Kohler et al., "Continuous cultures of fused cells secreting antibody of predefined specificity," (1975) Nature 256:495-497.
Kohn, K., "Anthramycin," Antibiotics III, Springer-Verlag, NY, 3-11 (1975).
Kojima et al., "Molecular Cloning and Expression of Megakaryocyte Potentiating Factor eDNA," The Journal of Biological Chemistry, vol. 270, No. 37, Issue of Sep. 15, pp. 21984-21990, 1995.
Konishi, M. et al., "Chicamycin, a new antitumor antibiotic II. Structure determination of chicamycins A and B," J. Antibiotics, 37, 200-206 (1984).
Konno et al., Biochem. J., (2000) 352, 783-788.
Kovtun et al., "Antibody-Drug Conjugates Designed to Eradicate Tumors with Homogeneous and Heterogeneous Expression of the Target Antigen," (2006) Cancer Res. 66(6):3214-3121.
Kuhns J.J., et al., "Poor Binding of a HER-2/neu Epitope (GP2) to HLA-A2.1 is due to a Lack of Interactions with the Center of the Peptide," J. Biol. Chem. 274, 36422-36427, 1999.
Kunimoto et al., "Mazethramycin, a new member of anthramycin group antibiotics," J. Antibiotics, 33, 665-667 (1980).
Kurebayashi et al., "Isolation and characterization of a new human breast cancer cell line, KPL-4, expressing the Erb B family receptors and interleukin•6," (1999) Brit. Jour. Cancer 79(5-6):707-717.
Lambert J., "Drug-conjugated monoclonal antibodies for the treatment of cancer," (2005) Current Opin. in Pharmacal. 5:543-549.
Langley, D.R. and Thurston, D.E., "A versatile and efficient synthesis of carbinolamine-containing pyrrolo[1,4]benzodiazepines via the cyclization of N-92-aminobenzoyl)pyrrolidine-2-carboxaldehyde diethyl thioacetals: total synthesis of prothracarcin," J. Org. Chem., 52, 91-97 (1987).
Larhammar et al., "Sequence of Gene and eDNA Encoding Murine Major Histocompatibility Complex Class II Gene AP2*," (1985) J. Biol. Chem. 260(26):14111-14119.
Launay et al., "TRPM4 is a Ca2+-Activated Nonselective Cation Channel Mediating Cell Membrane Depolarization," Cell 109 (3):397-407 (2002).
Law et al., "Lymphocyte Activation Antigen CD70 Expressed by Renal Cell Carcinoma is a Potential Therapeutic Target for Anti-CD70 Antibody-Drug Conjugates," (2006) Cancer Res. 66(4):2328-2337.
Le et al., "Primary structure and expression of a naturally truncated human P2X ATP receptor subunit from brain and immune system," (1997) FEBS Lett. 418(1-2):195-199.
Leber, J.D. et al., "A revised structure for sibiromycin," J. Am. Chem. Soc., 110, 2992-2993 (1988).
Leimgruber, W. et al., "Isolation and characterization of anthramycin, a new antitumor antibiotic," J. Am. Chem. Soc., 87, 5791-5793 (1965).
Leimgruber, W. et al., "The structure of anthramycin," J. Am. Chem. Soc., 87, 5793-5795 (1965).
Levenson et al., "MCF-7: The First Hormone-responsive Breast Cancer Cell Line," (1997) Cancer Res. 57(15):3071-3078.
Liang et al., "The Gene for a Novel Transmembrane Protein Containing Epidermal Growth Factor and Follistatin Domains is Frequently Hypermethylated in Human Tumor Cells," (2000) Cancer Res. 60:4907-4912.
Manfre et al., "Syntheses of Proline Analogues as Potential Mechanism-Based Inhibitors of Proline Dehydrogenase: 4-Methylene-L-, (E)- and (Z)-4-(Fluoromethylene)-L-, cis- and trans-5-Ethynyl-(±)-, and cis- and trans -5-Vinyl-L-proline," J. Org. Chem. 1992, 57, 2060-2065.

(56) References Cited

OTHER PUBLICATIONS

Marks et al., "By-passing Immunization, Human Antibodies from V-gene Libraries Displayed on Phage," (1991) J. Mol. Biol., 222:581-597.

Martin, C. et al., "Sequence-selective interaction of the minor-groove interstrand cross-linking agent SJG-136 with naked and cellular DNA: footprinting and enzyme inhibition studies," Biochem. (2005) 44(11):4135-4147.

Mastroberardino et al., "Amino-acid transport by heterodimers of 4F2hc/CD98 and members of a permease family," Nature 395 (6699):288-291 (1998).

McDonagh, "Engineered antibody-drug conjugates with defined sites and stoichiometries of drug attachment," (2006) Protein Eng. Design & Sel. 19(7): 299-307.

Mendoza et al., "Inhibition of Ligand-mediated HER2 Activation in Androgen-independent Prostate Cancer," (2002) Cancer Res. 62:5485-5488.

Miller et al., "Design, Construction, and In Vitro Analyses of Multivalent Antibodies," (2003) Jour. of Immunology 170:4854-4861.

Miller et al., "IRTAs: a new family of immunoglobulinlike receptors differentially expressed in B cells," Blood 99 (8):2662-2669 (2002).

Miura et al., "RPIOS is Associated With MD-1 and Transmits an Activation Signal in Human B Cells," (1996) Genomics 38(3):299-304.

Miura et al., "RPIOS is Associated With MD-1 and Transmits an Activation Signal in Human B Cells," (1998) Blood 92:2815-2822.

Moore M., et al., "Molecular cloning of the eDNA encoding the Epstein-Barr virus/C3d receptor (complement receptor type 2) of human B lymphocytes," Proc. Natl. Acad. Sci. U.S.A. 84, 9194-9198, 1987.

Morrison et al., "Chimeric human antibody molecules: Mouse antigen-binding domains with human constant region domains," (1984) Proc. Natl. Acad. Sci. USA, 81:6851-6855.

Mungall A.J., et al., "The DNA sequence and analysis of human chromosome 6," Nature 425, 805-811, 2003.

Nagase T., et al., "Prediction of the Coding Sequences of Unidentified Human Genes. XVII. The Complete Sequences of 100 New eDNA Clones from Brain Which Code for Large Proteins in vitro," (2000) DNA Res. 7 (2):143-150.

Nakamuta M., et al., "Cloning and Sequence Analysis of a cDNA Encoding Human Non-Selective Type of Endothelin Receptor," Biochem. Biophys. Res. Commun. 177, 34-39, 1991.

Nakayama et al., "Altered Gene Expression upon BCR Cross-Linking in Burkitt's Lymphoma B Cell Line," (2000) Biochem. Biophys. Res. Commun. 277(1):124-127.

Naruse et al., "The HLA-DOB gene displays limited polymorphism with only one amino acid substitution," (2002) Tissue Antigens 59:512-519.

Neuberger and Williams, "The intron requirement for immunoglobulin gene expression is dependent upon the promoter," (1988) Nucleic Acids Res. 16:6713-6724.

Nicolaou et al., "Calicheamicin 01: A Rationally Designed Molecule with Extremely Potent and Selective DNA Cleaving Properties and Apoptosis Inducing Activity," Angew Chem. Intl. Ed. Engl. (1994) 33:183-186.

Nilius et al., "Voltage Dependence of the Ca2+-activated Cation Channel TRPM4," The Journal of Biological Chemistry, vol. 278, No. 33, Issue of Aug. 15, pp. 30813-30820, 2003.

Ogawa Y., et al., "Molecular Cloning of a Non-Isopeptide-Selective Human Endothelin Receptor," Biochem. Biophys. Res. Commun. 178, 248-255, 1991.

Okamoto Y., et al. "Palmitoylation of Human EndothelinB," Biol. Chem. 272, 21589-21596, 1997.

Parrish-Novak J., et al., "lnterleukins 19, 20, and 24 Signal through Two Distinct Receptor Complexes," J. Biol. Chem. 277, 47517-47523, 2002.

Payne, G. "Progress in immunoconjugate cancer therapeutics," (2003) Cancer Cell 3:207-212.

Pingault V., et al., "SOX10 mutations in chronic intestinal pseudo-obstruction suggest a complex physiopathological mechanism," (2002) Hum. Genet. 111, 198-206.

Pletnev S., et al., "Characterization of the Recombinant Extracellular Domains of Human Interleukin-20 Receptors and Their Complexe with Interleukin-19 and Interleukin-20," (2003) Biochemistry 42:12617-12624.

Porkaa et al., "Cloning and Characterization of a Novel Six-Transmembrane Protein STEAP2, Expressed in Normal and Malignant Prostate," Lab. Invest. 82 (11):1573-1582 (2002).

Prasad et al.,"Human LAT1, a Subunit of System L Amino Acid Transporter: Molecular Cloning and Transport Function," Biochem. Biophys. Res. Commun. 255 (2), 283-288 (1999).

Preud'homme et al., "Structure and expression of the mb-1 transcript in human lymphoid cells," (1992) Clin. Exp. lmmunol. 90(1):141-146.

Puffenberger E.G., et al., "A Missense Mutation of the Endothelin-B Receptor Gene in Multigenic Hirschsprung's Disease," Cell 79, 1257-1266, 1994.

Rao et al., "Influence of diet on mammary cancer in transgenic mice bearing an oncogene expressed in mammary tissue," (1997) Breast Cancer Res. and Treatment 45:149-158.

Reiter R.E., et al., "Prostate stem cell antigen: A cell surface marker overexpressed in prostate cancer," Proc. Natl. Acad. Sci. U.S.A. 95, 1735-1740, 1998.

Rodrigues et al., "Synthesis and beta-lactamase-mediated activation of a cephalosporin-taxol prodrug," (1995) Chemistry Biology 2:223-227.

Ross et al., "Prostate Stem Cell Antigen as Therapy Target: Tissue Expression and in Vivo Efficacy of an Immunoconjugate," (2002) Cancer Res. 62:2546-2553.

Sakaguchi et al., "8 lymphocyte lineage-restricted expression of mb-1, a gene with CD3-like structural properties," (1988) EMBO J. 7(11):3457-3464.

Sakamoto A, Yanagisawa M., et al., "Cloning and Functional Expression of Human cDNA for the ETB Endothelin Receptor," Biochem. Biophys. Res. Commun. 178, 656-663, 1991.

Sanderson et al., "In vivo Drug-Linker Stability of an Anti-CD30 Dipeptide-Linked Auristatin Immunoconjugate," (2005) Clin. Cancer Res. 11:843-852.

Scholler et al., "Soluble member(s) of the mesothelin/megakaryocyte potentiating factor family are detectable in sera from patients with ovarian carcinoma," Proc. Natl. Acad. Sci. USA vol. 96, pp. 11531-11536, Sep. 1999.

Schroder and Lubke, The Peptides, vol. 1. pp. 76-136 (1965) Academic Press.

Segawa et al., "Growth-related Renal Type II Na/Pi Cotransporter," The Journal of Biolocjcal Chemistry, vol. 277. No. 22, Issue of May 31, pp. 19665-19672, 2002.

Semba K., et al., "A v-erbB-related protooncogene, c-erbB-2, is distinct from the c-erbB-1 /epidermal growth factor-receptor gene and is amplified in a human salivary gland adenocarcinoma," 15 Proc. Natl. Acad. Sci. U.S.A 82, 6497-6501, 1985.

Servenius et al., "Class II Genes of the Human Major Histocompatibility Complex, The DOBeta Gene is a Divergent Member of the Class II P Gene Family," (1987) J. Biol. Chem. 262:8759-8766.

Shamis et al., "Bioactivation of Self-Immolative Dendritic Prodrugs by Catalytic Antibody 38C2," (2004) J . Am. Chem. Soc. 126:1726-1731.

Sheikh F., et al., "Cutting Edge: IL-26 Signals through a Novel Receptor Complex Composed of IL-20 Receptor 1 and IL-10 Receptor 21," (2004) J.Immunol, 172, 2006-2010.

Shimizu et al., "Prothracarcin, a novel antitumor antibiotic," The Journal of Antibiotics (1982) 29, 2492-2503.

Sinha S.K., et al., "Characterization of the EBV /C3d Receptor on the Human Jurkat T Cell Line: Evidence for a Novel Transcript," (1993) J.Immunol. 150, 5311-5320.

Smellie, M. et al., "Sequence selective recognition of duplex DNA through covalent interstrand cross-linking," Biochem. (2003) 42:8232-8239.

Storm et al., "Effect of Small Changes in Orientation on Reaction Rate," (1972) J. Amer. Chem. Soc. 94:5815-5825.

(56) References Cited

OTHER PUBLICATIONS

Strausberg et al., "Generation and initial analysis of more than 15,000 full-length human and mouse cDNA sequences," (2002) Proc. Natl. Acad. Sci USA 99:16899-16903.
Sun et al., "Enabling ScFvs as Multi-Drug Carriers: A Dendritic Approach," (2003) Bioorganic & Medicinal Chemistry 11:1761-1768.
Sun et al., "Syntheses of Dendritic Linkers Containing Chlorambucil Residues for the Preparation of Antibody-Multidrug Immunoconjugates," (2002) Bioorganic & Medicinal Chemistry Letters 12:2213-2215.
Svensson P.J., et al., "Phenotypic variation in a family with mutations in two Hirschsprung-related genes (RET and endothelin receptor B)," Hum. Genet. 103, 145-148, 1998.
Swiercz J.M., et al., "Plexin-81 /RhoGEF-mediated Rho A activation involves the receptor tyrosine kinase ErbB-2," J. Cell Biol. 165, 869-880, 2004.
Syrigos and Epenetos, "Antibody Directed Enzyme Prodrug Therapy (ADEPT): A Review of the Experimental and Clinical Considerations," (1999) Anticancer Research 19:605-614.
Takeuchi, T. et al., "Neothramycins A and B, New Antitumor Antibiotics," J. Antibiotics, 29, 93-96 (1976).
Tawaragi Y., et al., "Primary Structure of Nonspecific Crossreacting Antigen (NCA), A Member of Carcinoembryonic Antigen (CEA) Gene Family, Deduced From cDNA Sequence," Biochem. Biophys. Res. Commun. 150, 89-96, 1988.
Thompson, J.S., et al., "BAFF-R, a Newly Identified TNF Receptor That Specifically Interacts with BAFF," Science 293 (5537), 2108-2111 (2001 ).
Thurston, D.E. et al., "Synthesis of Sequence-selective C8-linked Pyrrolo [2,1-c] [1,4] Benzodiazepine DNA Interstrand Cross-linking Agent," J. Org. Chem., 61:8141-8147 (1996).
Thurston, D.E. and Thompson, A.S., "The molecular recognition of DNA," Chem. Brit., 26, 767-772 (1990).
Thurston, D.E. and Bose, D.S., "Synthesis of DNA-Interactive Pyrrolo [2,1-c] [1,4]benzodiazepines," Chem. Rev., 94:433-465 (1994).
Toki et al., "Protease-Mediated Fragmentation of p-Amidobenzyl Ethers: A New Strategy for the Activation of Anticancer Prodrugs,"(2002) J. Org. Chem. 67:1866-1872.
Tonnelle et al., "DOBeta a new chain gene in HLA-D with a distinct regulation of expression," (1985) EMBO J. 4(11):2839-2847.
Touchman et al., "The Genomic Region Encompassing the Nephropathic Cystinosis Gene (CTNS): Complete Sequencing of a 200-kb Segment and Discovery of a Novel Gene within the Common Cystinosis-Causing Deletion," (2000) Genome Res. 10:165-173.
Trail et al., "Monoclonal antibody drug immunoconjugates for targeted treatment of cancer," (2003) Cancer Immunol. Immunother. 52:328-337.
Tsunakawa, M. et al., "Porothramycin, a new antibiotic of the anthramycin group: Production, isolation, structure and biological activity," J. Antibiotics, 41:1366-1373 (1988).
Tsutsumi M., et al., "Novel endothelin B receptor transcripts with the potential of generating a new receptor," Gene 228, 43-49, 1999.
Uchida et al., "A Novel Epidermal Growth Factor-like Molecule Containing Two Follistatin Modules Stimulates Tyrosine Phosphorylation of erbB-4 in MKN28 Gastric Cancer Cells," (1999) Biochem. Biophys. Res. Commun. 266:593-602.
Verheij J.B., et al., "ABCD Syndrome is Caused by a Homozygous Mutation in the EDNRB Gene," Am. J. Med. 15 Genet. 108, 223-225, 2002.
Von Hoegen et al., "Identifigation of a Human Protein Homologous to the Mouse Lyb-2 B Cell Differentiation Antigen and Sequence of the Corresponding cDNA," (1990) J. Immunol. 144(12):4870-4877.
Webster et al., "Mammary tumorigenesis and metastasis in transgenic mice," (1994) Semin Cancer Biol. 5:69-76.
Weis J.J., et al., "Identification of a partial cDNA clone for the C3d/Epstein-Barr virus receptor of human B lymphocytes: Homology with the receptor for fragments C3b and C4b of the third and fourth components of complement," Proc. Natl. Acad. Sci. U.S.A. 83, 5639-5643, 1986.
Weis J.J., et al., "Structure of the Human B Lymphocyte Receptor for C3d and the Epstein-Barr Virus and Relatedness to Other Members of the Family of C3/C4 Binding Proteins," J. Exp. Med. 167, 1047-1066, 1988.
Wilkinson, "Eph Receptors and Ephrins: Regulators of Guidance and Assembly," Int. Rev. Cytol. 196:177-244 (2000).
Wilson et al., "cDNA Cloning of the B Cell Membrane Protein CD22: A Mediator of B-B Cell Interactions," (1991) J. Exp. Med. 173:137-146.
Wu et al., "Arming antibodies: prospects and challenges for immunoconjugates," (2005) Nature Biotech. 23(9):1137-1145.
Xie et al., "In vivo behaviour of antibody- drug conjugates for the targeted treatment of cancer," (2006) Expert. Opin Biol. Ther. 6(3):281-291.
Xu et al., "Molecular Cloning, Functional Characterization, Tissue Distribution, and Chromosomal Localization of a Human, Small Intestinal Sodium-Phosphate (Na + -Pi) Transporter (SLC34A2)," Genomics 62 (2):281-284 (1999).
Xu, M.J., et al., "Molecular Cloning and Characterization of SPAP1, an Inhibitory Receptor," (2001) Biochem. Biophys. Res. Commun. 280 (3):768-775.
Xu, X.Z., et al., "Regulation of melastatin, a TRP-related protein, through interaction with a cytoplasmic isoform," Proc. Natl. Acad. Sci. U.S.A. 98 (19):10692-10697 (2001).
Yamaguchi, N., et al., "A Novel Cytokine Exhibiting Megakaryocyte Potentiating Activity From a Human Pancreatic Tumor Cell Line HPC-Y5," Biol. Chem. 269 (2), 805-808 (1994).
Yamamoto T., et al., "Similarity of protein encoded by the human c-erb-B-2 gene to epidermal growth factor receptor," Nature 319, 230-234, 1986.
Yang et al., "Murine Six-Transmembrane Epithelial Antigen of the Prostate, Prostate Stem Cell Antigen, and Prostate-specific Membrane Antigen: Prostate-specific Cell-Surface Antigens Highly Expressed in Prostate Cancer of Transgenic Adenocarcinoma Mouse Prostate Mice," Cancer Research, 61, 5857-5860. Aug. 1, 2001.
Yin & Lloyd, "Molecular Cloning of the CA125 Ovarian Cancer Antigen," J. Biol. Chem. 276 (29):27371-27375 (2001).
Yu et al., "Human mb-1 Gene: Complete cDNA Sequence and Its Expression in B Cells Bearing Membrane Ig of Various Isotypes," (1992) J. Immunol. 148(2) 633-637.
U.S. Appl. No. 14/774,535, filed Sep. 10, 2015, Howard et al.
U.S. Appl. No. 14/995,944, filed Jan. 14, 2016, Howard et al.

UNSYMMETRICAL PYRROLOBENZODIAZEPINES-DIMERS FOR USE IN THE TREATMENT OF PROLIFERATIVE AND AUTOIMMUNE DISEASES

The present invention relates to pyrrolobenzodiazepines (PBDs), and their inclusion in targeted conjugates. The PBDs of the present invention are in a mixed dimer where one PBD moiety comprises an imine or equivalent group and the other moiety comprises either an amine or amido group. The PBDs are linked to a cell binding agent via a substituent on the C2 position.

BACKGROUND TO THE INVENTION

Some pyrrolobenzodiazepines (PBDs) have the ability to recognise and bond to specific sequences of DNA; the preferred sequence is PuGPu. The first PBD antitumour antibiotic, anthramycin, was discovered in 1965 (Leimgruber, et al., *J. Am. Chem. Soc.*, 87, 5793-5795 (1965); Leimgruber, et al., *J. Am. Chem. Soc.*, 87, 5791-5793 (1965)). Since then, a number of naturally occurring PBDs have been reported, and numerous synthetic routes have been developed to a variety of analogues (Thurston, et al., *Chem. Rev.* 1994, 433-465 (1994); Antonow, D. and Thurston, D. E., *Chem. Rev.* 2011 111 (4), 2815-2864). Family members include abbeymycin (Hochlowski, et al., *J. Antibiotics*, 40, 145-148 (1987)), chicamycin (Konishi, et al., *J. Antibiotics*, 37, 200-206 (1984)), DC-81 (Japanese Patent 58-180 487; Thurston, et al., *Chem. Brit.*, 26, 767-772 (1990); Bose, et al., *Tetrahedron*, 48, 751-758 (1992)), mazethramycin (Kuminoto, et al., *J. Antibiotics*, 33, 665-667 (1980)), neothramycins A and B (Takeuchi, et al., *J. Antibiotics*, 29, 93-96 (1976)), porothramycin (Tsunakawa, et al., *J. Antibiotics*, 41, 1366-1373 (1988)), prothracarcin (Shimizu, et al, *J. Antibiotics*, 29, 2492-2503 (1982); Langley and Thurston, *J. Org. Chem.*, 52, 91-97 (1987)), sibanomicin (DC-102)(Hara, et al., *J. Antibiotics*, 41, 702-704 (1988); Itoh, et al., *J. Antibiotics*, 41, 1281-1284 (1988)), sibiromycin (Leber, et al., *J. Am. Chem. Soc.*, 110, 2992-2993 (1988)) and tomamycin (Arima, et al., *J. Antibiotics*, 25, 437-444 (1972)). PBDs are of the general structure:

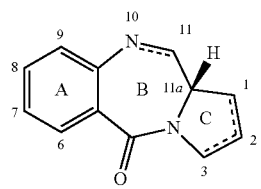

They differ in the number, type and position of substituents, in both their aromatic A rings and pyrrolo C rings, and in the degree of saturation of the C ring. In the B-ring there is either an imine (N=C), a carbinolamine(NH—CH(OH)), or a carbinolamine methyl ether (NH—CH(OMe)) at the N10-C11 position which is the electrophilic centre responsible for alkylating DNA. All of the known natural products have an (S)-configuration at the chiral C11a position which provides them with a right-handed twist when viewed from the C ring towards the A ring. This gives them the appropriate three-dimensional shape for isohelicity with the minor groove of B-form DNA, leading to a snug fit at the binding site (Kohn, In *Antibiotics III*. Springer-Verlag, New York, pp. 3-11 (1975); Hurley and Needham-VanDeventer, *Acc. Chem. Res.*, 19, 230-237 (1986)). Their ability to form an adduct in the minor groove, enables them to interfere with DNA processing, hence their use as antitumour agents.

It has been previously disclosed that the biological activity of these molecules can be potentiated by joining two PBD units together through their C8/C'-hydroxyl functionalities via a flexible alkylene linker (Bose, D. S., et al., *J. Am. Chem. Soc.*, 114, 4939-4941 (1992); Thurston, D. E., et al., *J. Org. Chem.*, 61, 8141-8147 (1996)). The PBD dimers are thought to form sequence-selective DNA lesions such as the palindromic 5'-Pu-GATC-Py-3' interstrand cross-link (Smellie, M., et al., *Biochemistry*, 42, 8232-8239 (2003); Martin, C., et al., *Biochemistry*, 44, 4135-4147) which is thought to be mainly responsible for their biological activity. One example of a PBD dimmer, SG2000 (SJG-136):

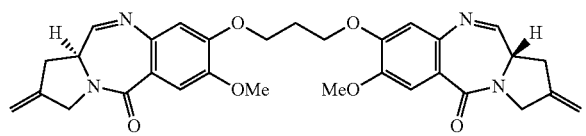

has recently entered Phase II clinical trials in the oncology area (Gregson, S., et al., *J. Med. Chem.*, 44, 737-748 (2001); Alley, M. C., et al., *Cancer Research*, 64, 6700-6706 (2004); Hartley, J. A., et al., *Cancer Research*, 64, 6693-6699 (2004)).

WO 2010/043880 discloses unsymmetrical dimeric PBD compound bearing aryl groups in the C2 position of each monomer, where one of these aryl groups bears a substituent designed to provide an anchor for linking the compound to another moiety. WO 2011/130613, discloses the inclusion of these PBD dimer compounds in targeted conjugates. WO 2011/130616, discloses unsymmetrical dimeric PBD compound bearing an aryl group in the C2 position of one monomer bearing a substituent designed to provide an anchor for linking the compound to another moiety, the other monomer bearing a non-aromatic group in the C2 position. The inclusion of these compounds in targeted conjugates is also disclosed. Co-pending International application PCT/EP2012/070233, filed 12 Oct. 2012, discloses further unsymmetrical dimeric PBD compound bearing an propyl-enyl group in the C2 position of one monomer bearing a substituent designed to provide an anchor for linking the compound to another moiety, the other monomer bearing an aromatic or non-aromatic group in the C2 position.

In 2002, Kamal described the synthesis and evaluation of PBD dimers having an imine bond in one PBD and an amide group in the other PBD (Kamal, A, et al., *J. Med. Chem.*, 2002, 4679-4688), such as:

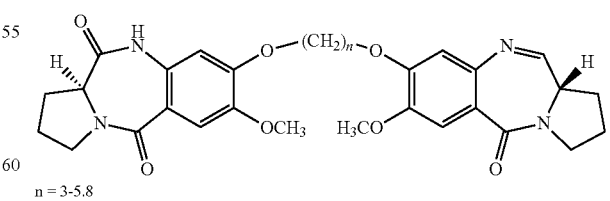

n = 3-5.8

In 2004, he described the synthesis and evaluation of PBD dimers having an imine bond in one PBD and an amine bond in the other PBD (Kamal, A, et al., *Bioorg. Med. Chem.*, 12 (2004) 5427-5436), such as:

n = 3
n = 5

These compounds are unable to cross-link DNA but were shown to possess some cytotoxicity.

DISCLOSURE OF THE INVENTION

A first aspect of the present invention comprises a compound with the formula I:

I or a pharmaceutically acceptable salt or solvate thereof, wherein:
$R^2$ is of formula IIa, formula IIb or formula IIc:

(a)

IIa where A is a $C_{5-7}$ aryl group, and either
(i) $Q^1$ is a single bond, and $Q^2$ is selected from a single bond and $-Z-(CH_2)_n-$, where Z is selected from a single bond, O, S and NH and n is from 1 to 3; or
(ii) $Q^1$ is $-CH=CH-$, and $Q^2$ is a single bond;

(b)

IIb where;
$R^{C1}$, $R^{C2}$ and $R^{C3}$ are independently selected from H and unsubstituted $C_{1-2}$ alkyl;

(c)

IIc where Q is selected from OH, SH and $NR^N$, and $R^N$ is selected from H, methyl and ethyl X is selected from the group comprising: OH, SH, $CO_2H$, COH, $N=C=O$, $NHNH_2$, $CONHNH_2$, $NHR^N$, wherein $R^N$ is selected from the group comprising H and $C_{1-4}$ alkyl;
and either:
when there is a double bond present between C2' and C3', $R^{12}$ is selected from the group consisting of:
(ia) $C_{5-10}$ aryl group, optionally substituted by one or more substituents selected from the group comprising: halo, nitro, cyano, ether, carboxy, ester, $C_{1-7}$ alkyl, $C_{3-7}$ heterocyclyl and bis-oxy-$C_{1-3}$ alkylene;
(ib) $C_{1-5}$ saturated aliphatic alkyl;
(ic) $C_{3-6}$ saturated cycloalkyl;

(id)

wherein each of $R^{21}$, $R^{22}$ and $R^{23}$ are independently selected from H, $C_{1-3}$ saturated alkyl, $C_{2-3}$ alkenyl, $C_{2-3}$ alkynyl and cyclopropyl, where the total number of carbon atoms in the $R^{12}$ group is no more than 5;

(ie)

wherein one of $R^{25a}$ and $R^{25b}$ is H and the other is selected from: phenyl, which phenyl is optionally substituted by a group selected from halo, methyl, methoxy; pyridyl; and thiophenyl; and (if)

where $R^{24}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo, methyl, methoxy; pyridyl; and thiophenyl;
when there is a single bond present between C2' and C3', $R^{12}$ is H or where $R^{26a}$ and $R^{26b}$ are independently selected from H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{26a}$ and $R^{26b}$ is H, the other is selected from nitrile and a $C_{1-4}$ alkyl ester;

$R^6$ and $R^9$ are independently selected from H, R, OH, OR, SH, SR, $NH_2$, NHR, NRR', nitro, $Me_3Sn$ and halo;

where R and R' are independently selected from optionally substituted $C_{1-12}$ alkyl, $C_{3-20}$ heterocyclyl and $C_{5-20}$ aryl groups;

$R^7$ is selected from H, R, OH, OR, SH, SR, $NH_2$, NHR, NHRR', nitro, $Me_3Sn$ and halo;

R" is a $C_{3-12}$ alkylene group, which chain may be interrupted by one or more heteroatoms, e.g. O, S, $NR^{N2}$ (where $R^{N2}$ is H or $C_{1-4}$ alkyl), and/or aromatic rings, e.g. benzene or pyridine;

Y and Y' are selected from O, S, or NH;

$R^{6'}$, $R^{7'}$, $R^{9'}$ are selected from the same groups as $R^6$, $R^7$ and $R^9$ respectively;

either:

(A) $R^{20}$ is H or Me and $R^{21a}$ and $R^{21b}$ are both H or together form =O and either:
  (i) $R^{10}$ is H, $R^{11a}$ is H and $R^{11b}$ is OH or $OR^A$, where $R^A$ is $C_{1-4}$ alkyl; or
  (ii) $R^{10}$ and $R^{11b}$ form a nitrogen-carbon double bond between the nitrogen and carbon atoms to which they are bound and $R^{11a}$ is H; or
  (iii) $R^{10}$ is H, $R^{11a}$ is H and $R^{11b}$ is $SO_zM$, where z is 2 or 3 and M is a monovalent pharmaceutically acceptable cation; or (B) $R^{10}$ is H or Me and $R^{11a}$ and $R^{11b}$ are both H or together form =O and either:
  (i) $R^{20}$ is H, $R^{21a}$ is H and $R^{21b}$ is OH or $OR^A$, where $R^A$ is $C_{1-4}$ alkyl; or
  (ii) $R^{20}$ and $R^{21b}$ form a nitrogen-carbon double bond between the nitrogen and carbon atoms to which they are bound and $R^{11a}$ is H; or
  (iii) $R^{20}$ is H, $R^{21a}$ is H and $R^{21b}$ is $SO_zM$, where z is 2 or 3 and M is a monovalent pharmaceutically acceptable cation.

Thus, the options (A) and (B) above can result in compounds of the following formulae (IA-a, IA-b, IB-a, IB-b):

IA-a
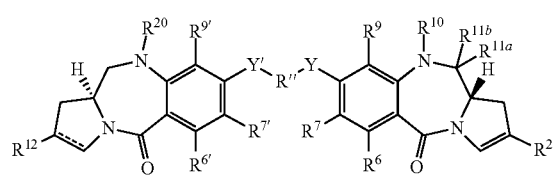

IA-b
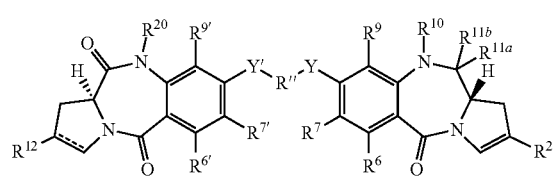

IB-a
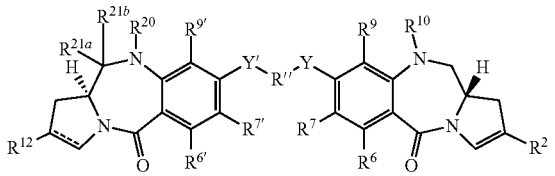

IB-b
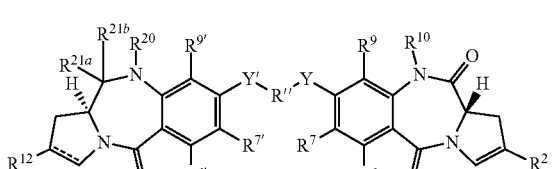

Dimers of the invention therefore have an imine bond in one monomer, that may be present as a carbinolamine, carbinolamine ether or bisulphite form, and either a second/tertiary amine or (methyl)amido functionality in the other monomer.

A second aspect of the present invention provides the use of a compound of the first aspect of the invention in the manufacture of a medicament for treating a proliferative disease. The second aspect also provides a compound of the first aspect of the invention for use in the treatment of a proliferative disease.

One of ordinary skill in the art is readily able to determine whether or not a candidate compound treats a proliferative condition for any particular cell type. For example, assays which may conveniently be used to assess the activity offered by a particular compound are described in the examples below.

A third aspect of the present invention provides a method of making a compound of the first aspect of the invention, comprising at least one of the method steps set out below.

A fourth aspect of the present invention provides compounds of formula III:

III
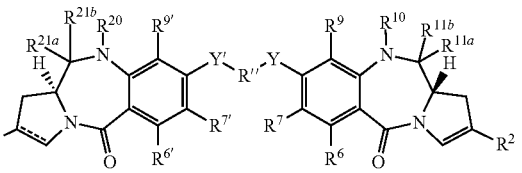

or a pharmaceutically acceptable salt or solvate thereof, wherein:

$R^{22}$ is selected from:

(a) formula IVa:

IVa
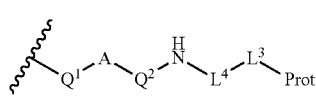

where A, $Q^1$, $Q^2$ are as defined in the first aspect of the invention;

(b) formula IVb:

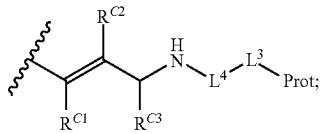

where $R^{C1}$, $R^{C2}$ and $R^{C3}$ are as defined in the first aspect of the invention;

(c) formula IVc:

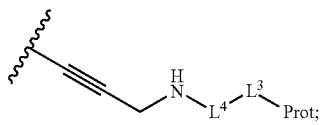

$L^4$ is selected from a single bond and a group of:

(a)
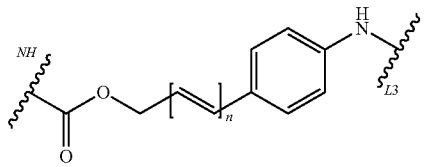

wherein n is 0 to 3;

(b)
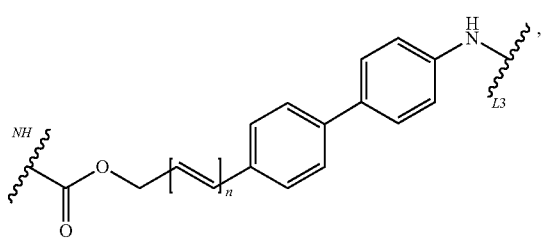

wherein n is as defined above;

(c)
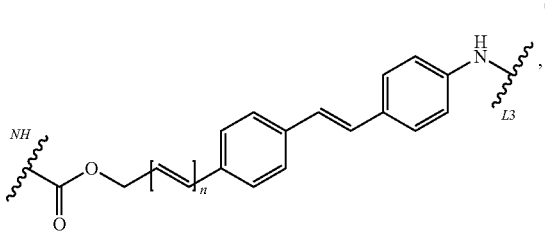

wherein n is as defined above; and (d)
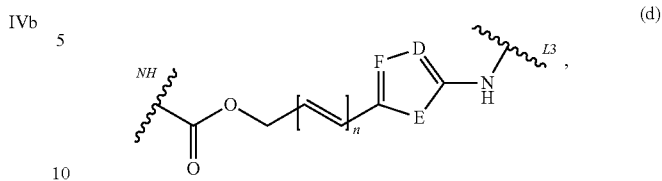

wherein n is as defined above, E is O, S or NR, D is N, CH, or CR, and F is N, CH, or CR;

$L^3$ is:

where X is such that $L^3$ is an amino-acid residue, a dipeptide residue or a tripeptide residue;

Prot is selected from Fmoc (fluorenylmethyloxycarbonyl), Teoc (2-(trimethylsilyl)ethoxycarbonyl), Boc (t-butoxycarbonyl) and Alloc (allyloxycarbonyl);

and $R^6$, $R^7$, $R^9$, $R^{6'}$, $R^{7'}$, $R^{9'}$, $R^{12}$, $R''$, $Y$, $Y'$, $R^{10}$, $R^{11a}$, $R^{11b}$, $R^{20}$, $R^{21a}$ and $R^{21b}$ are as defined in the first aspect of the invention.

In a fifth aspect, the present invention relates to Conjugates comprising dimers of PBDs linked to a targeting agent, wherein the PBD dimer is of formula I, or a pharmaceutically acceptable salt or solvate thereof (supra).

In some embodiments, the Conjugates have the following formula V:

$$L\text{-}(LU\text{-}D)_p \quad (V)$$

or a pharmaceutically acceptable salt or solvate thereof, wherein L is a Ligand unit (i.e., a targeting agent), LU is a Linker unit and D is a Drug unit that is a PBD dimer (see below). The subscript p is an integer of from 1 to 20. Accordingly, the Conjugates comprise a Ligand unit covalently linked to at least one Drug unit by a Linker unit. The Ligand unit, described more fully below, is a targeting agent that binds to a target moiety. The Ligand unit can, for example, specifically bind to a cell component (a Cell Binding Agent) or to other target molecules of interest. Accordingly, the present invention also provides methods for the treatment of, for example, various cancers and autoimmune disease. These methods encompass the use of the Conjugates wherein the Ligand unit is a targeting agent that specifically binds to a target molecule. The Ligand unit can be, for example, a protein, polypeptide or peptide, such as an antibody, an antigen-binding fragment of an antibody, or other binding agent, such as an Fc fusion protein.

In conjugates of the present invention, the PBD dimer D is of formula I, or a pharmaceutically acceptable salt or solvate thereof, except that X is selected from the group comprising: *—O—+, *—S—+, *—$CO_2$—+, *—CO—+, *—NH(C=O)—+, *—NHNH—+, *—CONHNH—+,

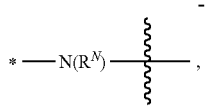

wherein $R^N$ is selected from the group comprising H and $C_{1-4}$ alkyl, and the asterix indicates the point of attachment to the remainder of the Drug unit and the wavy line or + indicates the point of attachment to the Linker Unit.

The drug loading is represented by p, the number of drug molecules per Ligand unit (e.g., an antibody). Drug loading may range from 1 to 20 Drug units (D) per Ligand unit (e.g., Ab or mAb). For compositions, p represents the average drug loading of the Conjugates in the composition, and p ranges from 1 to 20.

A sixth aspect of the present invention provides the use of a conjugate of the fifth aspect of the invention in the manufacture of a medicament for treating a proliferative disease. The sixth aspect also provides a conjugate of the fifth aspect of the invention for use in the treatment of a proliferative disease.

One of ordinary skill in the art is readily able to determine whether or not a candidate conjugate treats a proliferative condition for any particular cell type. For example, assays which may conveniently be used to assess the activity offered by a particular compound are described in the examples below.

In a seventh aspect, the present invention relates to Linker-Drug compounds (i.e., Drug-Linkers) comprising dimers of PBDs (see above) linked to a linking unit. These Drug-linkers can be used as intermediates for the synthesis of Conjugates comprising dimers of PBDs linked to a targeting agent.

These Drug-Linkers have the following formula VI:

$$LU\text{-}D \qquad (VI)$$

or a pharmaceutically acceptable salt or solvate thereof, wherein LU is a Linker unit and D is a Drug unit that is a PBD dimer.

In the Drug-Linkers of the present invention, the PBD dimer D is of formula I, or a pharmaceutically acceptable salt or solvate thereof, except that X is selected from the group comprising: *—O—$^q$, *—S—$^q$, *—CO$_2$—$^q$, *—CO—$^q$, *—NH(C=O)—$^q$, *—NHNH—$^q$, *—CONHNH—$^q$,

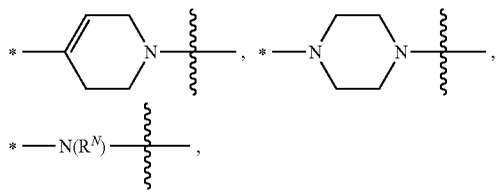

wherein $R^N$ is selected from the group comprising H and $C_{1-4}$ alkyl, and the asterix indicates the point of attachment to the remainder of the Drug unit and the wavy line or q indicates the point of attachment to the Linker Unit.

In some embodiments, the drug linkers are of formula III as defined above.

DEFINITIONS

Pharmaceutically Acceptable Cations

Examples of pharmaceutically acceptable monovalent and divalent cations are discussed in Berge, et al., *J. Pharm. Sci.*, 66, 1-19 (1977), which is incorporated herein by reference.

The pharmaceutically acceptable cation may be inorganic or organic.

Examples of pharmaceutically acceptable monovalent inorganic cations include, but are not limited to, alkali metal ions such as $Na^+$ and $K^+$. Examples of pharmaceutically acceptable divalent inorganic cations include, but are not limited to, alkaline earth cations such as $Ca^{2+}$ and $Mg^{2+}$. Examples of pharmaceutically acceptable organic cations include, but are not limited to, ammonium ion (i.e. $NH_4^+$) and substituted ammonium ions (e.g. $NH_3R^+$, $NH_2R_2^+$, $NHR_3^+$, $NR_4^+$). Examples of some suitable substituted ammonium ions are those derived from: ethylamine, diethylamine, dicyclohexylamine, triethylamine, butylamine, ethylenediamine, ethanolamine, diethanolamine, piperazine, benzylamine, phenylbenzylamine, choline, meglumine, and tromethamine, as well as amino acids, such as lysine and arginine. An example of a common quaternary ammonium ion is $N(CH_3)_4^+$.

Substituents

The phrase "optionally substituted" as used herein, pertains to a parent group which may be unsubstituted or which may be substituted.

Unless otherwise specified, the term "substituted" as used herein, pertains to a parent group which bears one or more substituents. The term "substituent" is used herein in the conventional sense and refers to a chemical moiety which is covalently attached to, or if appropriate, fused to, a parent group. A wide variety of substituents are well known, and methods for their formation and introduction into a variety of parent groups are also well known.

Examples of substituents are described in more detail below.

$C_{1-12}$ alkyl: The term "$C_{1-12}$ alkyl" as used herein, pertains to a monovalent moiety obtained by removing a hydrogen atom from a carbon atom of a hydrocarbon compound having from 1 to 12 carbon atoms, which may be aliphatic or alicyclic, and which may be saturated or unsaturated (e.g. partially unsaturated, fully unsaturated). The term "$C_{1-4}$ alkyl" as used herein, pertains to a monovalent moiety obtained by removing a hydrogen atom from a carbon atom of a hydrocarbon compound having from 1 to 4 carbon atoms, which may be aliphatic or alicyclic, and which may be saturated or unsaturated (e.g. partially unsaturated, fully unsaturated). Thus, the term "alkyl" includes the sub-classes alkenyl, alkynyl, cycloalkyl, etc., discussed below.

Examples of saturated alkyl groups include, but are not limited to, methyl ($C_1$), ethyl ($C_2$), propyl ($C_3$), butyl ($C_4$), pentyl ($C_5$), hexyl ($C_6$) and heptyl ($C_7$).

Examples of saturated linear alkyl groups include, but are not limited to, methyl ($C_1$), ethyl ($C_2$), n-propyl ($C_3$), n-butyl ($C_4$), n-pentyl (amyl) ($C_5$), n-hexyl ($C_6$) and n-heptyl ($C_7$).

Examples of saturated branched alkyl groups include iso-propyl ($C_3$), iso-butyl ($C_4$), sec-butyl ($C_4$), tert-butyl ($C_4$), iso-pentyl ($C_5$), and neo-pentyl ($C_5$).

$C_{2-12}$ Alkenyl: The term "$C_{2-12}$ alkenyl" as used herein, pertains to an alkyl group having one or more carbon-carbon double bonds.

Examples of unsaturated alkenyl groups include, but are not limited to, ethenyl (vinyl, —CH=CH$_2$), 1-propenyl (—CH═CH—CH$_3$), 2-propenyl (allyl, —CH—CH═CH$_2$), isopropenyl (1-methylvinyl, —C(CH$_3$)═CH$_2$), butenyl (C$_4$), pentenyl (C$_5$), and hexenyl (C$_6$).

C$_{2-12}$ alkynyl: The term "C$_{2-12}$ alkynyl" as used herein, pertains to an alkyl group having one or more carbon-carbon triple bonds.

Examples of unsaturated alkynyl groups include, but are not limited to, ethynyl (—C≡CH) and 2-propynyl (propargyl, —CH$_2$—C≡CH).

C$_{3-12}$ cycloalkyl: The term "C$_{3-12}$ cycloalkyl" as used herein, pertains to an alkyl group which is also a cyclyl group; that is, a monovalent moiety obtained by removing a hydrogen atom from an alicyclic ring atom of a cyclic hydrocarbon (carbocyclic) compound, which moiety has from 3 to 7 carbon atoms, including from 3 to 7 ring atoms.

Examples of cycloalkyl groups include, but are not limited to, those derived from:

saturated monocyclic hydrocarbon compounds:
cyclopropane (C$_3$), cyclobutane (C$_4$), cyclopentane (C$_5$), cyclohexane (C$_6$), cycloheptane (C$_7$), methylcyclopropane (C$_4$), dimethylcyclopropane (C$_5$), methylcyclobutane (C$_5$), dimethylcyclobutane (C$_6$), methylcyclopentane (C$_6$), dimethylcyclopentane (C$_7$) and methylcyclohexane (C$_7$);

unsaturated monocyclic hydrocarbon compounds:
cyclopropene (C$_3$), cyclobutene (C$_4$), cyclopentene (C$_5$), cyclohexene (C$_6$), methylcyclopropene (C$_4$), dimethylcyclopropene (C$_5$), methylcyclobutene (C$_5$), dimethylcyclobutene (C$_6$), methylcyclopentene (C$_6$), dimethylcyclopentene (C$_7$) and methylcyclohexene (C$_7$); and saturated polycyclic hydrocarbon compounds:
norcarane (C$_7$), norpinane (C$_7$), norbornane (C$_7$).

C$_{3-20}$ heterocyclyl: The term "C$_{3-20}$ heterocyclyl" as used herein, pertains to a monovalent moiety obtained by removing a hydrogen atom from a ring atom of a heterocyclic compound, which moiety has from 3 to 20 ring atoms, of which from 1 to 10 are ring heteroatoms. Preferably, each ring has from 3 to 7 ring atoms, of which from 1 to 4 are ring heteroatoms.

In this context, the prefixes (e.g. C$_{3-20}$, C$_{3-7}$, C$_{5-6}$, etc.) denote the number of ring atoms, or range of number of ring atoms, whether carbon atoms or heteroatoms. For example, the term "C$_{5-6}$heterocyclyl", as used herein, pertains to a heterocyclyl group having 5 or 6 ring atoms.

Examples of monocyclic heterocyclyl groups include, but are not limited to, those derived from:

N$_1$: aziridine (C$_3$), azetidine (C$_4$), pyrrolidine (tetrahydropyrrole) (C$_5$), pyrroline (e.g., 3-pyrroline, 2,5-dihydropyrrole) (C$_5$), 2H-pyrrole or 3H-pyrrole (isopyrrole, isoazole) (C$_5$), piperidine (C$_6$), dihydropyridine (C$_6$), tetrahydropyridine (C$_6$), azepine (C$_7$);

O$_1$: oxirane (C$_3$), oxetane (C$_4$), oxolane (tetrahydrofuran) (C$_5$), oxole (dihydrofuran) (C$_5$), oxane (tetrahydropyran) (C$_6$), dihydropyran (C$_6$), pyran (C$_6$), oxepin (C$_7$);

S$_1$: thiirane (C$_3$), thietane (C$_4$), thiolane (tetrahydrothiophene) (C$_5$), thiane (tetrahydrothiopyran) (C$_6$), thiepane (C$_7$);

O$_2$: dioxolane (C$_5$), dioxane (C$_6$), and dioxepane (C$_7$);

O$_3$: trioxane (C$_6$);

N$_2$: imidazolidine (C$_5$), pyrazolidine (diazolidine) (C$_5$), imidazoline (C$_5$), pyrazoline (dihydropyrazole) (C$_5$), piperazine (C$_6$);

N$_1$O$_1$: tetrahydrooxazole (C$_5$), dihydrooxazole (C$_5$), tetrahydroisoxazole (C$_5$), dihydroisoxazole (C$_5$), morpholine (C$_6$), tetrahydrooxazine (C$_6$), dihydrooxazine (C$_6$), oxazine (C$_6$);

N$_1$S$_1$: thiazoline (C$_5$), thiazolidine (C$_5$), thiomorpholine (C$_6$);

N$_2$O$_1$: oxadiazine (C$_6$);

O$_1$S$_1$: oxathiole (C$_5$) and oxathiane (thioxane) (C$_6$); and,

N$_1$O$_1$S$_1$: oxathiazine (C$_6$).

Examples of substituted monocyclic heterocyclyl groups include those derived from saccharides, in cyclic form, for example, furanoses (C$_5$), such as arabinofuranose, lyxofuranose, ribofuranose, and xylofuranse, and pyranoses (C$_6$), such as allopyranose, altropyranose, glucopyranose, mannopyranose, gulopyranose, idopyranose, galactopyranose, and talopyranose.

C$_{5-20}$ aryl: The term "C$_{5-20}$ aryl", as used herein, pertains to a monovalent moiety obtained by removing a hydrogen atom from an aromatic ring atom of an aromatic compound, which moiety has from 3 to 20 ring atoms. The term "C$_{5-7}$ aryl", as used herein, pertains to a monovalent moiety obtained by removing a hydrogen atom from an aromatic ring atom of an aromatic compound, which moiety has from 5 to 7 ring atoms and the term "C$_{5-10}$ aryl", as used herein, pertains to a monovalent moiety obtained by removing a hydrogen atom from an aromatic ring atom of an aromatic compound, which moiety has from 5 to 10 ring atoms. Preferably, each ring has from 5 to 7 ring atoms.

In this context, the prefixes (e.g. C$_{3-20}$, C$_{5-7}$, C$_{5-6}$, C$_{5-10}$, etc.) denote the number of ring atoms, or range of number of ring atoms, whether carbon atoms or heteroatoms. For example, the term "C$_{5-6}$ aryl" as used herein, pertains to an aryl group having 5 or 6 ring atoms.

The ring atoms may be all carbon atoms, as in "carboaryl groups".

Examples of carboaryl groups include, but are not limited to, those derived from benzene (i.e. phenyl) (C$_6$), naphthalene (C$_{10}$), azulene (C$_{10}$), anthracene (C$_{14}$), phenanthrene (C$_{14}$), naphthacene (C$_{18}$), and pyrene (C$_{16}$).

Examples of aryl groups which comprise fused rings, at least one of which is an aromatic ring, include, but are not limited to, groups derived from indane (e.g. 2,3-dihydro-1H-indene) (C$_9$), indene (C$_9$), isoindene (C$_9$), tetraline (1,2,3,4-tetrahydronaphthalene (C$_{10}$), acenaphthene (C$_{12}$), fluorene (C$_{13}$), phenalene (C$_{13}$), acephenanthrene (C$_{15}$), and aceanthrene (C$_{16}$).

Alternatively, the ring atoms may include one or more heteroatoms, as in "heteroaryl groups". Examples of monocyclic heteroaryl groups include, but are not limited to, those derived from:

N$_1$: pyrrole (azole) (C$_5$), pyridine (azine) (C$_6$);

O$_1$: furan (oxole) (C$_5$);

S$_1$: thiophene (thiole) (C$_5$);

N$_1$O$_1$: oxazole (C$_5$), isoxazole (C$_5$), isoxazine (C$_6$);

N$_2$O$_1$: oxadiazole (furazan) (C$_5$);

N$_3$O$_1$: oxatriazole (C$_5$);

N$_1$S$_1$: thiazole (C$_5$), isothiazole (C$_5$);

N$_2$: imidazole (1,3-diazole) (C$_5$), pyrazole (1,2-diazole) (C$_5$), pyridazine (1,2-diazine) (C$_6$), pyrimidine (1,3-diazine) (C$_6$) (e.g., cytosine, thymine, uracil), pyrazine (1,4-diazine) (C$_6$);

N$_3$: triazole (C$_5$), triazine (C$_6$); and,

N$_4$: tetrazole (C$_5$).

Examples of heteroaryl which comprise fused rings, include, but are not limited to:

C$_9$ (with 2 fused rings) derived from benzofuran (O$_1$), isobenzofuran (O$_1$), indole (N$_1$), isoindole (N$_1$), indolizine (N$_1$), indoline (N$_1$), isoindoline (N$_1$), purine (N$_4$) (e.g., adenine, guanine), benzimidazole (N$_2$), indazole (N$_2$), benzoxazole (N$_1$O$_1$), benzisoxazole (N$_1$O$_1$), benzodioxole (O$_2$), benzofurazan (N$_2$O$_1$), benzotriazole (N$_3$), benzothiofuran (S$_1$), benzothiazole (N$_1$S$_1$), benzothiadiazole (N$_2$S);

$C_{10}$ (with 2 fused rings) derived from chromene ($O_1$), isochromene ($O_1$), chroman ($O_1$), isochroman ($O_1$), benzodioxan ($O_2$), quinoline ($N_1$), isoquinoline ($N_1$), quinolizine ($N_1$), benzoxazine ($N_1O_1$), benzodiazine ($N_2$), pyridopyridine ($N_2$), quinoxaline ($N_2$), quinazoline ($N_2$), cinnoline ($N_2$), phthalazine ($N_2$), naphthyridine ($N_2$), pteridine ($N_4$);

$C_{11}$ (with 2 fused rings) derived from benzodiazepine ($N_2$);

$C_{13}$ (with 3 fused rings) derived from carbazole ($N_1$), dibenzofuran ($O_1$), dibenzothiophene ($S_1$), carboline ($N_2$), perimidine ($N_2$), pyridoindole ($N_2$); and, $C_{14}$ (with 3 fused rings) derived from acridine ($N_1$), xanthene ($O_1$), thioxanthene ($S_1$), oxanthrene ($O_2$), phenoxathiin ($O_1S_1$), phenazine ($N_2$), phenoxazine ($N_1O_1$), phenothiazine ($N_1S_1$), thianthrene ($S_2$), phenanthridine ($N_1$), phenanthroline ($N_2$), phenazine ($N_2$).

The above groups, whether alone or part of another substituent, may themselves optionally be substituted with one or more groups selected from themselves and the additional substituents listed below.

Halo: —F, —Cl, —Br, and —I.

Hydroxy: —OH.

Ether: —OR, wherein R is an ether substituent, for example, a $C_{1-7}$ alkyl group (also referred to as a $C_{1-7}$ alkoxy group, discussed below), a $C_{3-20}$ heterocyclyl group (also referred to as a $C_{3-20}$ heterocyclyloxy group), or a $C_{5-20}$ aryl group (also referred to as a $C_{5-20}$ aryloxy group), preferably a $C_{1-7}$ alkyl group.

Alkoxy: —OR, wherein R is an alkyl group, for example, a $C_{1-7}$ alkyl group. Examples of $C_{1-7}$ alkoxy groups include, but are not limited to, —OMe (methoxy), —OEt (ethoxy), —O(nPr) (n-propoxy), —O(iPr) (isopropoxy), —O(nBu) (n-butoxy), —O(sBu) (sec-butoxy), —O(iBu) (isobutoxy), and —O(tBu) (tert-butoxy).

Acetal: —CH(OR$^1$)(OR$^2$), wherein R$^1$ and R$^2$ are independently acetal substituents, for example, a $C_{1-7}$ alkyl group, a $C_{3-20}$ heterocyclyl group, or a $C_{5-20}$ aryl group, preferably a $C_{1-7}$ alkyl group, or, in the case of a "cyclic" acetal group, R$^1$ and R$^2$, taken together with the two oxygen atoms to which they are attached, and the carbon atoms to which they are attached, form a heterocyclic ring having from 4 to 8 ring atoms. Examples of acetal groups include, but are not limited to, —CH(OMe)$_2$, —CH(OEt)$_2$, and —CH(OMe)(OEt).

Hemiacetal: —CH(OH)(OR$^1$), wherein R$^1$ is a hemiacetal substituent, for example, a $C_{1-7}$ alkyl group, a $C_{3-20}$ heterocyclyl group, or a $C_{5-20}$ aryl group, preferably a $C_{1-7}$ alkyl group. Examples of hemiacetal groups include, but are not limited to, —CH(OH)(OMe) and —CH(OH)(OEt).

Ketal: —CR(OR$^1$)(OR$^2$), where R$^1$ and R$^2$ are as defined for acetals, and R is a ketal substituent other than hydrogen, for example, a $C_{1-7}$ alkyl group, a $C_{3-20}$ heterocyclyl group, or a $C_{5-20}$ aryl group, preferably a $C_{1-7}$ alkyl group. Examples ketal groups include, but are not limited to, —C(Me)(OMe)$_2$, —C(Me)(OEt)$_2$, —C(Me)(OMe)(OEt), —C(Et)(OMe)$_2$, —C(Et)(OEt)$_2$, and —C(Et)(OMe)(OEt).

Hemiketal: —CR(OH)(OR$^1$), where R$^1$ is as defined for hemiacetals, and R is a hemiketal substituent other than hydrogen, for example, a $C_{1-7}$ alkyl group, a $C_{3-20}$ heterocyclyl group, or a $C_{5-20}$ aryl group, preferably a $C_{1-7}$ alkyl group. Examples of hemiacetal groups include, but are not limited to, —C(Me)(OH)(OMe), —C(Et)(OH)(OMe), —C(Me)(OH)(OEt), and —C(Et)(OH)(OEt).

Oxo (keto, -one): =O.

Thione (thioketone): =S.

Imino (imine): =NR, wherein R is an imino substituent, for example, hydrogen, $C_{1-7}$ alkyl group, a $C_{3-20}$ heterocyclyl group, or a $C_{5-20}$ aryl group, preferably hydrogen or a $C_{1-7}$ alkyl group. Examples of ester groups include, but are not limited to, =NH, =NMe, =NEt, and =NPh.

Formyl (carbaldehyde, carboxaldehyde): —C(=O)H.

Acyl (keto): —C(=O)R, wherein R is an acyl substituent, for example, a $C_{1-7}$ alkyl group (also referred to as $C_{1-7}$ alkylacyl or $C_{1-7}$ alkanoyl), a $C_{3-20}$ heterocyclyl group (also referred to as $C_{3-20}$ heterocyclylacyl), or a $C_{5-20}$ aryl group (also referred to as $C_{5-20}$ arylacyl), preferably a $C_{1-7}$ alkyl group. Examples of acyl groups include, but are not limited to, —C(=O)CH$_3$ (acetyl), —C(=O)CH$_2$CH$_3$ (propionyl), —C(=O)C(CH$_3$)$_3$ (t-butyryl), and —C(=O)Ph (benzoyl, phenone).

Carboxy (carboxylic acid): —C(=O)OH.

Thiocarboxy (thiocarboxylic acid): —C(=S)SH.

Thiolocarboxy (thiolocarboxylic acid): —C(=O)SH.

Thionocarboxy (thionocarboxylic acid): —C(=S)OH.

Imidic acid: —C(=NH)OH.

Hydroxamic acid: —C(=NOH)OH.

Ester (carboxylate, carboxylic acid ester, oxycarbonyl): —C(=O)OR, wherein R is an ester substituent, for example, a $C_{1-7}$ alkyl group, a $C_{3-20}$ heterocyclyl group, or a $C_{5-20}$ aryl group, preferably a $C_{1-7}$ alkyl group. Examples of ester groups include, but are not limited to, —C(=O)OCH$_3$, —C(=O)OCH$_2$CH$_3$, —C(=O)OC(CH$_3$)$_3$, and —C(=O)OPh.

Acyloxy (reverse ester): —OC(=O)R, wherein R is an acyloxy substituent, for example, a $C_{1-7}$ alkyl group, a $C_{3-20}$ heterocyclyl group, or a $C_{5-20}$ aryl group, preferably a $C_{1-7}$ alkyl group. Examples of acyloxy groups include, but are not limited to, —OC(=O)CH$_3$ (acetoxy), —OC(=O)CH$_2$CH$_3$, —OC(=O)C(CH$_3$)$_3$, —OC(=O)Ph, and —OC(=O)CH$_2$Ph.

Oxycarboyloxy: —OC(=O)OR, wherein R is an ester substituent, for example, a $C_{1-7}$ alkyl group, a $C_{3-20}$ heterocyclyl group, or a $C_{5-20}$ aryl group, preferably a $C_{1-7}$ alkyl group. Examples of ester groups include, but are not limited to, —OC(=O)OCH$_3$, —OC(=O)OCH$_2$CH$_3$, —OC(=O)OC(CH$_3$)$_3$, and —OC(=O)OPh.

Amino: —NR$^1$R$^2$, wherein R$^1$ and R$^2$ are independently amino substituents, for example, hydrogen, a $C_{1-7}$ alkyl group (also referred to as $C_{1-7}$ alkylamino or di-$C_{1-7}$alkylamino), a $C_{3-20}$ heterocyclyl group, or a $C_{5-20}$ aryl group, preferably H or a $C_{1-7}$ alkyl group, or, in the case of a "cyclic" amino group, R$^1$ and R$^2$, taken together with the nitrogen atom to which they are attached, form a heterocyclic ring having from 4 to 8 ring atoms. Amino groups may be primary (—NH$_2$), secondary (—NHR$^1$), or tertiary (—NHR$^1$R$^2$), and in cationic form, may be quaternary (—$^+$NR$^1$R$^2$R$^3$). Examples of amino groups include, but are not limited to, —NH$_2$, —NHCH$_3$, —NHC(CH$_3$)$_2$, —N(CH$_3$)$_2$, —N(CH$_2$CH$_3$)$_2$, and —NHPh. Examples of cyclic amino groups include, but are not limited to, aziridino, azetidino, pyrrolidino, piperidino, piperazino, morpholino, and thiomorpholino.

Amido (carbamoyl, carbamyl, aminocarbonyl, carboxamide): —C(=O)NR$^1$R$^2$, wherein R$^1$ and R$^2$ are independently amino substituents, as defined for amino groups. Examples of amido groups include, but are not limited to, —C(=O)NH$_2$, —C(=O)NHCH$_3$, —C(=O)N(CH$_3$)$_2$, —C(=O)NHCH$_2$CH$_3$, and —C(=O)N(CH$_2$CH$_3$)$_2$, as well as amido groups in which R$^1$ and R$^2$, together with the nitrogen atom to which they are attached, form a heterocyclic structure as in, for example, piperidinocarbonyl, morpholinocarbonyl, thiomorpholinocarbonyl, and piperazinocarbonyl.

Thioamido (thiocarbamyl): —C(=S)NR$^1$R$^2$, wherein R$^1$ and R$^2$ are independently amino substituents, as defined for amino groups. Examples of amido groups include, but are not limited to, —C(=S)NH$_2$, —C(=S)NHCH$_3$, —C(=S)N(CH$_3$)$_2$, and —C(=S)NHCH$_2$CH$_3$.

Acylamido (acylamino): —NR$^1$C(=O)R$^2$, wherein R$^1$ is an amide substituent, for example, hydrogen, a C$_{1-7}$ alkyl group, a C$_{3-20}$ heterocyclyl group, or a C$_{5-20}$ aryl group, preferably hydrogen or a C$_{1-7}$ alkyl group, and R$^2$ is an acyl substituent, for example, a C$_{1-7}$ alkyl group, a C$_{3-20}$ heterocyclyl group, or a C$_{5-20}$aryl group, preferably hydrogen or a C$_{1-7}$ alkyl group. Examples of acylamide groups include, but are not limited to, —NHC(=O)CH$_3$, —NHC(=O)CH$_2$CH$_3$, and —NHC(=O)Ph. R$^1$ and R$^2$ may together form a cyclic structure, as in, for example, succinimidyl, maleimidyl, and phthalimidyl:

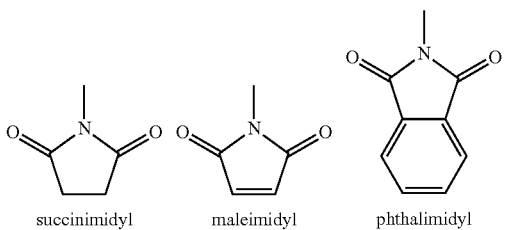

succinimidyl    maleimidyl    phthalimidyl

Aminocarbonyloxy: —OC(=O)NR$^1$R$^2$, wherein R$^1$ and R$^2$ are independently amino substituents, as defined for amino groups. Examples of aminocarbonyloxy groups include, but are not limited to, —OC(=O)NH$_2$, —OC(=O)NHMe, —OC(=O)NMe$_2$, and —OC(=O)NEt$_2$.

Ureido: —N(R$^1$)CONR$^2$R$^3$ wherein R$^2$ and R$^3$ are independently amino substituents, as defined for amino groups, and R$^1$ is a ureido substituent, for example, hydrogen, a C$_{1-7}$ alkyl group, a C$_{3-20}$ heterocyclyl group, or a C$_{5-20}$ aryl group, preferably hydrogen or a C$_{1-7}$ alkyl group. Examples of ureido groups include, but are not limited to, —NHCONH$_2$, —NHCONHMe, —NHCONHEt, —NHCONMe$_2$, —NHCONEt$_2$, —NMeCONH$_2$, —NMeCONHMe, —NMeCONHEt, —NMeCONMe$_2$, and —NMeCONEt$_2$.

Guanidino: —NH—C(=NH)NH$_2$.

Tetrazolyl: a five membered aromatic ring having four nitrogen atoms and one carbon atom,

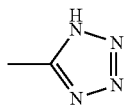

Imino: =NR, wherein R is an imino substituent, for example, for example, hydrogen, a C$_{1-7}$ alkyl group, a C$_{3-20}$ heterocyclyl group, or a C$_{5-20}$ aryl group, preferably H or a C$_{1-7}$alkyl group. Examples of imino groups include, but are not limited to, =NH, =NMe, and =NEt.

Amidine (amidino): —C(=NR)NR$_2$, wherein each R is an amidine substituent, for example, hydrogen, a C$_{1-7}$ alkyl group, a C$_{3-20}$ heterocyclyl group, or a C$_{5-20}$ aryl group, preferably H or a C$_{1-7}$ alkyl group. Examples of amidine groups include, but are not limited to, —C(=NH)NH$_2$, —C(=NH)NMe$_2$, and —C(=NMe)NMe$_2$.

Nitro: —NO$_2$.

Nitroso: —NO.

Azido: —N$_3$.

Cyano (nitrile, carbonitrile): —CN.

Isocyano: —NC.

Cyanato: —OCN.

Isocyanato: —NCO.

Thiocyano (thiocyanato): —SCN.

Isothiocyano (isothiocyanato): —NCS.

Sulfhydryl (thiol, mercapto): —SH.

Thioether (sulfide): —SR, wherein R is a thioether substituent, for example, a C$_{1-7}$ alkyl group (also referred to as a C$_{1-7}$alkylthio group), a C$_{3-20}$ heterocyclyl group, or a C$_{5-20}$ aryl group, preferably a C$_{1-7}$ alkyl group. Examples of C$_{1-7}$ alkylthio groups include, but are not limited to, —SCH$_3$ and —SCH$_2$CH$_3$.

Disulfide: —SS—R, wherein R is a disulfide substituent, for example, a C$_{1-7}$ alkyl group, a C$_{3-20}$ heterocyclyl group, or a C$_{5-20}$ aryl group, preferably a C$_{1-7}$ alkyl group (also referred to herein as C$_{1-7}$ alkyl disulfide). Examples of C$_{1-7}$ alkyl disulfide groups include, but are not limited to, —SSCH$_3$ and —SSCH$_2$CH$_3$.

Sulfine (sulfinyl, sulfoxide): —S(=O)R, wherein R is a sulfine substituent, for example, a C$_{1-7}$ alkyl group, a C$_{3-20}$ heterocyclyl group, or a C$_{5-20}$ aryl group, preferably a C$_{1-7}$ alkyl group. Examples of sulfine groups include, but are not limited to, —S(=O)CH$_3$ and —S(=O)CH$_2$CH$_3$.

Sulfone (sulfonyl): —S(=O)$_2$R, wherein R is a sulfone substituent, for example, a C$_{1-7}$ alkyl group, a C$_{3-20}$ heterocyclyl group, or a C$_{5-20}$ aryl group, preferably a C$_{1-7}$ alkyl group, including, for example, a fluorinated or perfluorinated C$_{1-7}$ alkyl group. Examples of sulfone groups include, but are not limited to, —S(=O)$_2$CH$_3$ (methanesulfonyl, mesyl), —S(=O)$_2$CF$_3$ (triflyl), —S(=O)$_2$CH$_2$CH$_3$ (esyl), —S(=O)$_2$C$_4$F$_9$ (nonaflyl), —S(=O)$_2$CH$_2$CF$_3$ (tresyl), —S(=O)$_2$CH$_2$CH$_2$NH$_2$ (tauryl), —S(=O)$_2$Ph (phenylsulfonyl, besyl), 4-methylphenylsulfonyl (tosyl), 4-chlorophenylsulfonyl (closyl), 4-bromophenylsulfonyl (brosyl), 4-nitrophenyl (nosyl), 2-naphthalenesulfonate (napsyl), and 5-dimethylamino-naphthalen-1-ylsulfonate (dansyl).

Sulfinic acid (sulfino): —S(=O)OH, —SO$_2$H.

Sulfonic acid (sulfo): —S(=O)$_2$OH, —SO$_3$H.

Sulfinate (sulfinic acid ester): —S(=O)OR; wherein R is a sulfinate substituent, for example, a C$_{1-7}$ alkyl group, a C$_{3-20}$ heterocyclyl group, or a C$_{5-20}$ aryl group, preferably a C$_{1-7}$ alkyl group. Examples of sulfinate groups include, but are not limited to, —S(=O)OCH$_3$ (methoxysulfinyl; methyl sulfinate) and —S(=O)OCH$_2$CH$_3$ (ethoxysulfinyl; ethyl sulfinate).

Sulfonate (sulfonic acid ester): —S(=O)$_2$OR, wherein R is a sulfonate substituent, for example, a C$_{1-7}$ alkyl group, a C$_{3-20}$ heterocyclyl group, or a C$_{5-20}$ aryl group, preferably a C$_{1-7}$ alkyl group. Examples of sulfonate groups include, but are not limited to, —S(=O)$_2$OCH$_3$ (methoxysulfonyl; methyl sulfonate) and —S(=O)$_2$OCH$_2$CH$_3$ (ethoxysulfonyl; ethyl sulfonate).

Sulfinyloxy: —OS(=O)R, wherein R is a sulfinyloxy substituent, for example, a C$_{1-7}$ alkyl group, a C$_{3-20}$ heterocyclyl group, or a C$_{5-20}$ aryl group, preferably a C$_{1-7}$ alkyl group. Examples of sulfinyloxy groups include, but are not limited to, —OS(=O)CH$_3$ and —OS(=O)CH$_2$CH$_3$.

Sulfonyloxy: —OS(=O)$_2$R, wherein R is a sulfonyloxy substituent, for example, a C$_{1-7}$ alkyl group, a C$_{3-20}$ heterocyclyl group, or a C$_{5-20}$ aryl group, preferably a C$_{1-7}$ alkyl group.

Examples of sulfonyloxy groups include, but are not limited to, —OS(=O)$_2$CH$_3$ (mesylate) and —OS(=O)$_2$CH$_2$CH$_3$ (esylate).

Sulfate: —OS(=O)$_2$OR; wherein R is a sulfate substituent, for example, a $C_{1-7}$ alkyl group, a $C_{3-20}$ heterocyclyl group, or a $C_{5-20}$ aryl group, preferably a $C_{1-7}$ alkyl group. Examples of sulfate groups include, but are not limited to, —OS(=O)$_2$OCH$_3$ and —SO(=O)$_2$OCH$_2$CH$_3$.

Sulfamyl (sulfamoyl; sulfinic acid amide; sulfinamide): —S(=O)NR$^1$R$^2$, wherein R$^1$ and R$^2$ are independently amino substituents, as defined for amino groups. Examples of sulfamyl groups include, but are not limited to, —S(=O) NH$_2$, —S(=O)NH(CH$_3$), —S(=O)N(CH$_3$)$_2$, —S(=O)NH (CH$_2$CH$_3$), —S(=O)N(CH$_2$CH$_3$)$_2$, and —S(=O)NHPh.

Sulfonamido (sulfinamoyl; sulfonic acid amide; sulfonamide): —S(=O)$_2$NR$^1$R$^2$, wherein R$^1$ and R$^2$ are independently amino substituents, as defined for amino groups. Examples of sulfonamido groups include, but are not limited to, —S(=O)$_2$NH$_2$, —S(=O)$_2$NH(CH$_3$), —S(=O)$_2$N (CH$_3$)$_2$, —S(=O)$_2$NH(CH$_2$CH$_3$), —S(=O)$_2$N(CH$_2$CH$_3$)$_2$, and —S(=O)$_2$NHPh.

Sulfamino: —NR$^1$S(=O)$_2$OH, wherein R$^1$ is an amino substituent, as defined for amino groups. Examples of sulfamino groups include, but are not limited to, —NHS(=O)$_2$OH and —N(CH$_3$)S(=O)$_2$OH.

Sulfonamino: —NR$^1$S(=O)$_2$R, wherein R$^1$ is an amino substituent, as defined for amino groups, and R is a sulfonamino substituent, for example, a $C_{1-7}$ alkyl group, a $C_{3-20}$ heterocyclyl group, or a $C_{5-20}$ aryl group, preferably a $C_{1-7}$ alkyl group. Examples of sulfonamino groups include, but are not limited to, —NHS(=O)$_2$CH$_3$ and —N(CH$_3$)S(=O)$_2$C$_6$H$_5$.

Sulfinamino: —NR$^1$S(=O)R, wherein R$^1$ is an amino substituent, as defined for amino groups, and R is a sulfinamino substituent, for example, a $C_{1-7}$ alkyl group, a $C_{3-20}$ heterocyclyl group, or a $C_{5-20}$ aryl group, preferably a $C_{1-7}$ alkyl group. Examples of sulfinamino groups include, but are not limited to, —NHS(=O)CH$_3$ and —N(CH$_3$)S(=O) C$_6$H$_5$.

Phosphino (phosphine): —PR$_2$, wherein R is a phosphino substituent, for example, —H, a $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphino groups include, but are not limited to, —PH$_2$, —P(CH$_3$)$_2$, —P(CH$_2$CH$_3$)$_2$, —P(t-Bu)$_2$, and —P(Ph)$_2$.

Phospho: —P(=O)$_2$.

Phosphinyl (phosphine oxide): —P(=O)R$_2$, wherein R is a phosphinyl substituent, for example, a $C_{1-7}$ alkyl group, a $C_{3-20}$ heterocyclyl group, or a $C_{5-20}$ aryl group, preferably a $C_{1-7}$ alkyl group or a $C_{5-20}$ aryl group. Examples of phosphinyl groups include, but are not limited to, —P(=O) (CH$_3$)$_2$, —P(=O)(CH$_2$CH$_3$)$_2$, —P(=O)(t-Bu)$_2$, and —P(=O)(Ph)$_2$.

Phosphonic acid (phosphono): —P(=O)(OH)$_2$.

Phosphonate (phosphono ester): —P(=O)(OR)$_2$, where R is a phosphonate substituent, for example, —H, a $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphonate groups include, but are not limited to, —P(=O)(OCH$_3$)$_2$, —P(=O)(OCH$_2$CH$_3$)$_2$, —P(=O)(O-t-Bu)$_2$, and —P(=O)(OPh)$_2$.

Phosphoric acid (phosphonooxy): —OP(=O)(OH)$_2$.

Phosphate (phosphonooxy ester): —OP(=O)(OR)$_2$, where R is a phosphate substituent, for example, —H, a $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphate groups include, but are not limited to, —OP(=O)(OCH$_3$)$_2$, —OP(=O)(OCH$_2$CH$_3$)$_2$, —OP(=O)(O-t-Bu)$_2$, and —OP(=O)(OPh)$_2$.

Phosphorous acid: —OP(OH)$_2$.

Phosphite: —OP(OR)$_2$, where R is a phosphite substituent, for example, —H, a $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphite groups include, but are not limited to, —OP(OCH$_3$)$_2$, —OP (OCH$_2$CH$_3$)$_2$, —OP(O-t-Bu)$_2$, and —OP(OPh)$_2$.

Phosphoramidite: —OP(OR$^1$)—NR$^2$$_2$, where R$^1$ and R$^2$ are phosphoramidite substituents, for example, —H, a (optionally substituted) $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphoramidite groups include, but are not limited to, —OP(OCH$_2$CH$_3$)— N(CH$_3$)$_2$, —OP(OCH$_2$CH$_3$)—N(i-Pr)$_2$, and —OP (OCH$_2$CH$_2$CN)—N(i-Pr)$_2$.

Phosphoramidate: —OP(=O)(OR$^1$)—NR$^2$$_2$, where R$^1$ and R$^2$ are phosphoramidate substituents, for example, —H, a (optionally substituted) $C_{1-7}$ alkyl group, a $C_{3-20}$ heterocyclyl group, or a $C_{5-20}$ aryl group, preferably —H, a $C_{1-7}$ alkyl group, or a $C_{5-20}$ aryl group. Examples of phosphoramidate groups include, but are not limited to, —OP(=O) (OCH$_2$CH$_3$)—N(CH$_3$)$_2$, —OP(=O)(OCH$_2$CH$_3$)— N(i-Pr)$_2$, and —OP(=O)(OCH$_2$CH$_2$CN)—N(i-Pr)$_2$.

Alkylene $C_{3-12}$ alkylene: The term "$C_{3-12}$ alkylene", as used herein, pertains to a bidentate moiety obtained by removing two hydrogen atoms, either both from the same carbon atom, or one from each of two different carbon atoms, of a hydrocarbon compound having from 3 to 12 carbon atoms (unless otherwise specified), which may be aliphatic or alicyclic, and which may be saturated, partially unsaturated, or fully unsaturated. Thus, the term "alkylene" includes the subclasses alkenylene, alkynylene, cycloalkylene, etc., discussed below.

Examples of linear saturated $C_{3-12}$ alkylene groups include, but are not limited to, —(CH$_2$)$_n$— where n is an integer from 3 to 12, for example, —CH$_2$CH$_2$CH$_2$— (propylene), —CH$_2$CH$_2$CH$_2$CH$_2$— (butylene), —CH$_2$CH$_2$CH$_2$CH$_2$CH$_2$— (pentylene) and —CH$_2$CH$_2$CH$_2$CH—$_2$CH$_2$CH$_2$CH$_2$— (heptylene).

Examples of branched saturated $C_{3-12}$ alkylene groups include, but are not limited to, —CH(CH$_3$)CH$_2$—, —CH (CH$_3$)CH$_2$CH$_2$—, —CH(CH$_3$)CH$_2$CH$_2$CH$_2$—, —CH$_2$CH (CH$_3$)CH$_2$—, —CH$_2$CH(CH$_3$)CH$_2$CH$_2$—, —CH (CH$_2$CH$_3$)—, —CH(CH$_2$CH$_3$)CH$_2$—, and —CH$_2$CH (CH$_2$CH$_3$)CH$_2$—.

Examples of linear partially unsaturated $C_{3-12}$ alkylene groups ($C_{3-12}$ alkenylene, and alkynylene groups) include, but are not limited to, —CH=CH—CH$_2$—, —CH$_2$— CH=CH$_2$—, —CH=CH—CH$_2$—CH$_2$—, —CH=CH— CH$_2$—CH$_2$—CH$_2$—, —CH=CH—CH=CH—, —CH=CH—CH=CH—CH$_2$—, —CH=CH— CH=CH—CH$_2$—CH$_2$—, —CH=CH—CH$_2$— CH=CH—, —CH=CH—CH$_2$—CH$_2$—CH=CH—, and —CH$_2$—, C≡C—CH$_2$—.

Examples of branched partially unsaturated $C_{3-12}$ alkylene groups ($C_{3-12}$ alkenylene and alkynylene groups) include, but are not limited to, —C(CH$_3$)=CH—, —C(CH$_3$)=CH—CH$_2$—, —CH=CH—CH(CH$_3$)— and —C≡C—CH(CH$_3$)—.

Examples of alicyclic saturated $C_{3-12}$ alkylene groups ($C_{3-12}$ cycloalkylenes) include, but are not limited to, cyclopentylene (e.g. cyclopent-1,3-ylene), and cyclohexylene (e.g. cyclohex-1,4-ylene).

Examples of alicyclic partially unsaturated $C_{3-12}$ alkylene groups ($C_{3-12}$ cycloalkylenes) include, but are not limited to, cyclopentenylene (e.g. 4-cyclopenten-1,3-ylene), cyclohexenylene (e.g. 2-cyclohexen-1,4-ylene; 3-cyclohexen-1,2-ylene; 2,5-cyclohexadien-1,4-ylene).

Oxygen protecting group: the term "oxygen protecting group" refers to a moiety which masks a hydroxy group, and these are well known in the art. A large number of suitable groups are described on pages 23 to 200 of Greene, T. W. and Wuts, G. M., Protective Groups in Organic Synthesis, 3$^{rd}$ Edition, John Wiley & Sons, Inc., 1999, which is incorporated herein by reference. Classes of particular interest include silyl ethers (e.g. TMS, TBDMS), substituted methyl ethers (e.g. THP) and esters (e.g. acetate).

Carbamate nitrogen protecting group: the term "carbamate nitrogen protecting group" pertains to a moiety which masks the nitrogen in the imine bond, and these are well known in the art. These groups have the following structure:

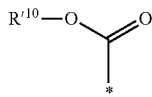

wherein R$'^{10}$ is R as defined above. A large number of suitable groups are described on pages 503 to 549 of Greene, T. W. and Wuts, G. M., Protective Groups in Organic Synthesis, 3$^{rd}$ Edition, John Wiley & Sons, Inc., 1999, which is incorporated herein by reference.

Hemi-aminal nitrogen protecting group: the term "hemi-aminal nitrogen protecting group" pertains to a group having the following structure:

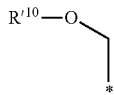

wherein R$'^{10}$ is R as defined above. A large number of suitable groups are described on pages 633 to 647 as amide protecting groups of Greene, T. W. and Wuts, G. M., Protective Groups in Organic Synthesis, 3$^{rd}$ Edition, John Wiley & Sons, Inc., 1999, which is incorporated herein by reference.

Conjugates

The present invention provides Conjugates comprising a PBD dimer connected to a Ligand unit via a Linker unit. In one embodiment, the Linker unit includes a Stretcher unit (A), a Specificity unit (L$^1$), and a Spacer unit (L$^2$). The Linker unit is connected at one end to the Ligand unit (L) and at the other end to the PBD dimer compound (D).

In one aspect, such a Conjugate is shown below in formula Va:

$$L\text{-}(A^1_a\text{-}L^1_s\text{-}L^2_y\text{-}D)_p \quad (Va)$$

or a pharmaceutically acceptable salt or solvate thereof, wherein:
L is the Ligand unit; and
-A$^1_a$-L$^1_s$-L$^2_y$- is a Linker unit (LU), wherein:
-A$^1$- is a Stretcher unit,
a is 1 or 2,
-L$^1$- is a Specificity unit,
s is an integer ranging from 0 to 12,
-L$^2$- is a Spacer unit,
y is 0, 1 or 2;
-D is a PBD dimer; and
p is from 1 to 20.

In another aspect, such a Conjugate is shown below in formula Vb:

(Vb)

Also illustrated as:

$$L\text{-}(A^1_a\text{-}L^2_y(\text{-}L^1_s)\text{-}D)_p \quad (Vb)$$

or a pharmaceutically acceptable salt or solvate thereof, wherein:
L is the Ligand unit; and
-A$^1_a$-L$^1_s$(L$^2_y$)- is a Linker unit (LU), wherein:
-A$^1$- is a Stretcher unit linked to a Spacer unit (L$^2$),
a is 1 or 2,
-L$^1$- is a Specificity unit linked to a Spacer unit (L$^2$),
s is an integer ranging from 0 to 12,
-L$^2$- is a Spacer unit,
y is 0, 1 or 2;
-D is a PBD dimer; and
p is from 1 to 20.

Preferences

The following preferences may apply to all aspects of the invention as described above, or may relate to a single aspect. The preferences may be combined together in any combination.

In one embodiment, the Conjugate has the formula:

$$L\text{-}(A^1_a\text{-}L^1_s\text{-}L^2_y\text{-}D)_p$$

$$L\text{-}(A^1_a\text{-}L_s^1\text{-}D)_p,$$

$$L\text{-}(A^1\text{-}L^1\text{-}D)_p \text{ or}$$

$$L\text{-}(A^1\text{-}D)_p$$

or a pharmaceutically acceptable salt or solvate thereof, wherein L, A$^1$, a, L$^1$, s, L$^2$, D, y and p are as described above.

The present invention is suitable for use in providing a PBD compound to a preferred site in a subject. In the preferred embodiments, the conjugate allows the release of an active PBD compound that does not retain any part of the linker. There is no stub present that could affect the reactivity of the PBD compound.

In certain embodiments, the invention provides conjugates comprising a PBD dimer group having a linker connected to a cell binding agent. The present inventors describe herein methods of synthesis that enable such dimer conjugates to be prepared.

The linker attaches the Ligand Unit (L), e.g. antibody, to the PBD drug moiety D through covalent bond(s). The linker is a bifunctional or multifunctional moiety which can be used to link one or more drug moiety (D) and an antibody unit (Ab) to form antibody-drug conjugates (ADC). The linker may be stable outside a cell, i.e. extracellular, or it may be cleavable by enzymatic activity, hydrolysis, or other metabolic conditions. Antibody-drug conjugates (ADC) can be conveniently prepared using a linker having reactive functionality for binding to the drug moiety and to the antibody. A cysteine thiol, or an amine, e.g. N-terminus or amino acid side chain such as lysine, of the antibody (Ab) can form a bond with a functional group of a linker or spacer reagent, PBD drug moiety (D) or drug-linker reagent (D-R$^L$).

The linkers of the ADC preferably prevent aggregation of ADC molecules and keep the ADC freely soluble in aqueous media and in a monomeric state.

The linkers of the ADC are preferably stable extracellularly. Before transport or delivery into a cell, the antibody-drug conjugate (ADC) is preferably stable and remains intact, i.e. the antibody remains linked to the drug moiety. The linkers are stable outside the target cell and may be cleaved at some efficacious rate inside the cell. An effective linker will: (i) maintain the specific binding properties of the antibody; (ii) allow intracellular delivery of the conjugate or drug moiety; (iii) remain stable and intact, i.e. not cleaved, until the conjugate has been delivered or transported to its targetted site; and (iv) maintain a cytotoxic, cell-killing effect or a cytostatic effect of the PBD drug moiety. Stability of the ADC may be measured by standard analytical techniques such as mass spectroscopy, HPLC, and the separation/analysis technique LC/MS.

Covalent attachment of the antibody and the drug moiety requires the linker to have two reactive functional groups, i.e. bivalency in a reactive sense. Bivalent linker reagents which are useful to attach two or more functional or biologically active moieties, such as peptides, nucleic acids, drugs, toxins, antibodies, haptens, and reporter groups are known, and methods have been described their resulting conjugates (Hermanson, G. T. (1996) Bioconjugate Techniques; Academic Press: New York, p 234-242).

In another embodiment, the linker may be substituted with groups which modulate aggregation, solubility or reactivity. For example, a sulfonate substituent may increase water solubility of the reagent and facilitate the coupling reaction of the linker reagent with the antibody or the drug moiety, or facilitate the coupling reaction of Ab-L with D, or D-L with Ab, depending on the synthetic route employed to prepare the ADC.

In one embodiment, the Ligand unit (L) is a Cell Binding Agent (CBA) that specifically binds to a target molecule on the surface of a target cell. An exemplary formula is illustrated below:

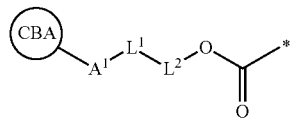

where the asterisk indicates the point of attachment to the Drug unit (D), CBA is the Cell Binding Agent, $L^1$ is a Specificity unit, $A^1$ is a Stretcher unit connecting $L^1$ to the Cell Binding Agent, $L^2$ is a Spacer unit, which is a covalent bond, a self-immolative group or together with —OC(=O)— forms a self-immolative group, and $L^2$ is optional. —OC(=O)— may be considered as being part of $L^1$ or $L^2$, as appropriate.

In another embodiment, the Ligand unit (L) is a Cell Binding Agent (CBA) that specifically binds to a target molecule on the surface of a target cell. An exemplary formula is illustrated below:

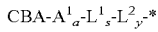

where the asterisk indicates the point of attachment to the Drug unit (D), CBA is the Cell Binding Agent, $L^1$ is a Specificity unit, $A^1$ is a Stretcher unit connecting $L^1$ to the Cell Binding Agent, $L^2$ is a Spacer unit which is a covalent bond or a self-immolative group, and a is 1 or 2, s is 0, 1 or 2, and y is 0 or 1 or 2.

In the embodiments illustrated above, $L^1$ can be a cleavable Specificity unit, and may be referred to as a "trigger" that when cleaved activates a self-immolative group (or self-immolative groups) $L^2$, when a self-immolative group(s) is present. When the Specificity unit $L^1$ is cleaved, or the linkage (i.e., the covalent bond) between $L^1$ and $L^2$ is cleaved, the self-immolative group releases the Drug unit (D).

In another embodiment, the Ligand unit (L) is a Cell Binding Agent (CBA) that specifically binds to a target molecule on the surface of a target cell. An exemplary formula is illustrated below:

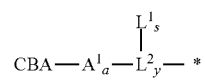

where the asterisk indicates the point of attachment to the Drug (D), CBA is the Cell Binding Agent, $L^1$ is a Specificity unit connected to $L^2$, $A^1$ is a Stretcher unit connecting $L^2$ to the Cell Binding Agent, $L^2$ is a self-immolative group, and a is 1 or 2, s is 1 or 2, and y is 1 or 2.

In the various embodiments discussed herein, the nature of $L^1$ and $L^2$ can vary widely. These groups are chosen on the basis of their characteristics, which may be dictated in part, by the conditions at the site to which the conjugate is delivered. Where the Specificity unit $L^1$ is cleavable, the structure and/or sequence of $L^1$ is selected such that it is cleaved by the action of enzymes present at the target site (e.g., the target cell). $L^1$ units that are cleavable by changes in pH (e.g. acid or base labile), temperature or upon irradiation (e.g. photolabile) may also be used. $L^1$ units that are cleavable under reducing or oxidising conditions may also find use in the Conjugates.

In some embodiments, $L^1$ may comprise one amino acid or a contiguous sequence of amino acids. The amino acid sequence may be the target substrate for an enzyme.

In one embodiment, $L^1$ is cleavable by the action of an enzyme. In one embodiment, the enzyme is an esterase or a peptidase. For example, $L^1$ may be cleaved by a lysosomal protease, such as a cathepsin.

In one embodiment, $L^2$ is present and together with —C(=O)O— forms a self-immolative group or self-immolative groups. In some embodiments, —C(=O)O— also is a self-immolative group.

In one embodiment, where $L^1$ is cleavable by the action of an enzyme and $L^2$ is present, the enzyme cleaves the bond between $L^1$ and $L^2$, whereby the self-immolative group(s) release the Drug unit.

$L^1$ and $L^2$, where present, may be connected by a bond selected from:
—C(=O)NH—,
—C(=O)O—,
—NHC(=O)—,
—OC(=O)—,
—OC(=O)O—,
—NHC(=O)O—,
—OC(=O)NH—,
—NHC(=O)NH, and
—O— (a glycosidic bond).

An amino group of $L^1$ that connects to $L^2$ may be the N-terminus of an amino acid or may be derived from an amino group of an amino acid side chain, for example a lysine amino acid side chain.

A carboxyl group of $L^1$ that connects to $L^2$ may be the C-terminus of an amino acid or may be derived from a carboxyl group of an amino acid side chain, for example a glutamic acid amino acid side chain.

A hydroxy group of $L^1$ that connects to $L^2$ may be derived from a hydroxy group of an amino acid side chain, for example a serine amino acid side chain.

In one embodiment, —C(=O)O— and $L^2$ together form the group:

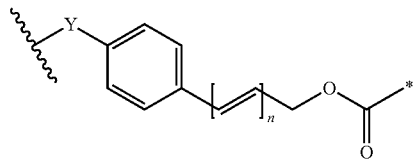

where the asterisk indicates the point of attachment to the Drug unit, the wavy line indicates the point of attachment to the $L^1$, Y is —N(H)—, —O—, —C(=O)N(H)— or —C(=O)O—, and n is 0 to 3. The phenylene ring is optionally substituted with one, two or three substituents as described herein.

In one embodiment, Y is NH.

In one embodiment, n is 0 or 1. Preferably, n is 0.

Where Y is NH and n is 0, the self-immolative group may be referred to as a p-aminobenzylcarbonyl linker (PABC).

The self-immolative group will allow for release of the Drug unit (i.e., the asymmetric PBD) when a remote site in the linker is activated, proceeding along the lines shown below (for n=0):

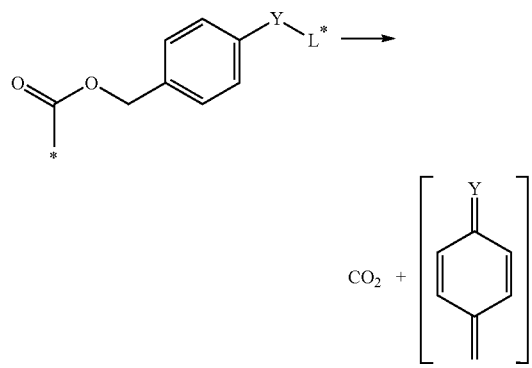

where the asterisk indicates the attachment to the Drug, L* is the activated form of the remaining portion of the linker and the released Drug unit is not shown. These groups have the advantage of separating the site of activation from the Drug.

In another embodiment, —C(=O)O— and $L^2$ together form a group selected from:

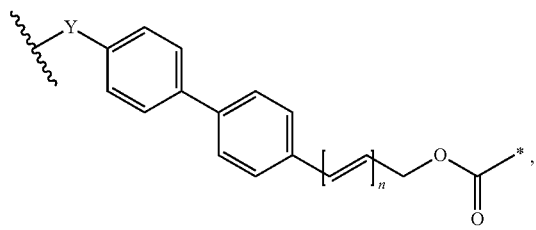

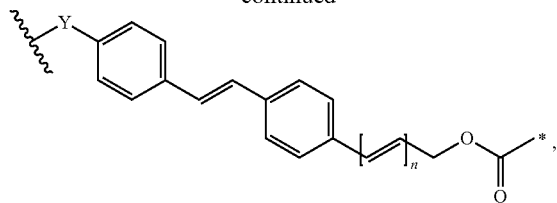

where the asterisk, the wavy line, Y, and n are as defined above. Each phenylene ring is optionally substituted with one, two or three substituents as described herein. In one embodiment, the phenylene ring having the Y substituent is optionally substituted and the phenylene ring not having the Y substituent is unsubstituted.

In another embodiment, —C(=O)O— and $L^2$ together form a group selected from:

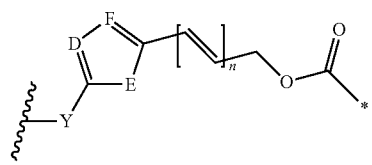

where the asterisk, the wavy line, Y, and n are as defined above, E is O, S or NR, D is N, CH, or CR, and F is N, CH, or CR.

In one embodiment, D is N.
In one embodiment, D is CH.
In one embodiment, E is O or S.
In one embodiment, F is CH.

In a preferred embodiment, the covalent bond between $L^1$ and $L^2$ is a cathepsin labile (e.g., cleavable) bond.

In one embodiment, $L^1$ comprises a dipeptide. The amino acids in the dipeptide may be any combination of natural amino acids and non-natural amino acids. In some embodiments, the dipeptide comprises natural amino acids. Where the linker is a cathepsin labile linker, the dipeptide is the site of action for cathepsin-mediated cleavage. The dipeptide then is a recognition site for cathepsin.

In one embodiment, the group —$X_1$—$X_2$— in dipeptide, —NH—$X_1$—$X_2$—CO—, is selected from:
-Phe-Lys-,
-Val-Ala-,
-Val-Lys-,
-Ala-Lys-,
-Val-Cit-,
-Phe-Cit-,
-Leu-Cit-,
-Ile-Cit-,
-Phe-Arg-, and
-Trp-Cit-;
where Cit is citrulline. In such a dipeptide, —NH— is the amino group of $X_1$, and CO is the carbonyl group of $X_2$.

Preferably, the group —$X_1$—$X_2$— in dipeptide, —NH—$X_1$—$X_2$—CO—, is selected from:
-Phe-Lys-,
-Val-Ala-,
-Val-Lys-,
-Ala-Lys-, and
-Val-Cit-.

Most preferably, the group —$X_1$—$X_2$— in dipeptide, —NH—$X_1$—$X_2$—CO—, is -Phe-Lys-, Val-Cit or -Val-Ala-.

Other dipeptide combinations of interest include:
-Gly-Gly-,
-Pro-Pro-, and
-Val-Glu-.

Other dipeptide combinations may be used, including those described by Dubowchik et al., which is incorporated herein by reference.

In one embodiment, the amino acid side chain is chemically protected, where appropriate. The side chain protecting group may be a group as discussed below. Protected amino acid sequences are cleavable by enzymes. For example, a dipeptide sequence comprising a Boc side chain-protected Lys residue is cleavable by cathepsin.

Protecting groups for the side chains of amino acids are well known in the art and are described in the Novabiochem Catalog. Additional protecting group strategies are set out in Protective groups in Organic Synthesis, Greene and Wuts.

Possible side chain protecting groups are shown below for those amino acids having reactive side chain functionality:
Arg: Z, Mtr, Tos;
Asn: Trt, Xan;
Asp: Bzl, t-Bu;
Cys: Acm, Bzl, Bzl-OMe, Bzl-Me, Trt;
Glu: Bzl, t-Bu;
Gln: Trt, Xan;
His: Boc, Dnp, Tos, Trt;
Lys: Boc, Z—Cl, Fmoc, Z;
Ser: Bzl, TBDMS, TBDPS;
Thr: Bz;
Trp: Boc;
Tyr: Bzl, Z, Z—Br.

In one embodiment, —$X_2$— is connected indirectly to the Drug unit. In such an embodiment, the Spacer unit $L^2$ is present.

In one embodiment, the dipeptide is used in combination with a self-immolative group(s) (the Spacer unit). The self-immolative group(s) may be connected to —$X_2$—.

Where a self-immolative group is present, —$X_2$— is connected directly to the self-immolative group. In one embodiment, —$X_2$— is connected to the group Y of the self-immolative group. Preferably the group —$X_2$—CO— is connected to Y, where Y is NH.

In one embodiment, —$X_1$— is connected directly to $A^1$. Preferably the group NH—$X_1$— (the amino terminus of $X_1$) is connected to $A^1$. $A^1$ may comprise the functionality —CO— thereby to form an amide link with —$X_1$—.

In one embodiment, $L^1$ and $L^2$ together with —OC(=O)— comprise the group —$X_1$—$X_2$-PABC-. The PABC group is connected directly to the Drug unit. In one example, the self-immolative group and the dipeptide together form the group -Phe-Lys-PABC-, which is illustrated below:

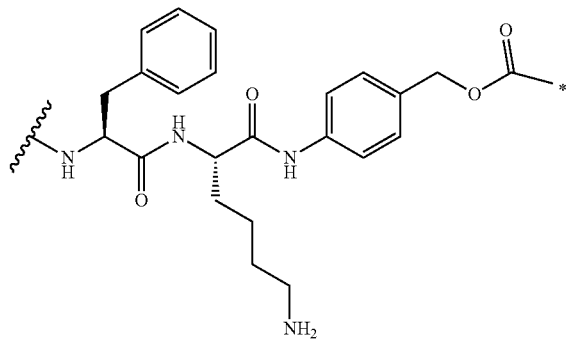 [SMILES: *N[C@@H](Cc1ccccc1)C(=O)N[C@@H](CCCCN)C(=O)Nc1ccc(COC(C)=O)cc1]

where the asterisk indicates the point of attachment to the Drug unit, and the wavy line indicates the point of attachment to the remaining portion of $L^1$ or the point of attachment to $A^1$. Preferably, the wavy line indicates the point of attachment to $A^1$.

Alternatively, the self-immolative group and the dipeptide together form the group -Val-Ala-PABC-, which is illustrated below:

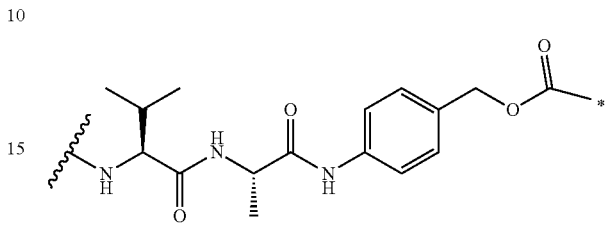

where the asterisk and the wavy line are as defined above.

In another embodiment, $L^1$ and $L^2$ together with —OC(=O)— represent:

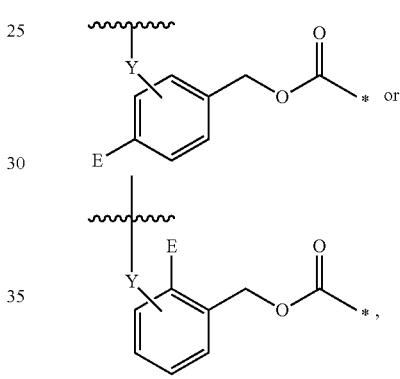

where the asterisk indicates the point of attachment to the Drug unit, the wavy line indicates the point of attachment to $A^1$, Y is a covalent bond or a functional group, and E is a group that is susceptible to cleavage thereby to activate a self-immolative group.

E is selected such that the group is susceptible to cleavage, e.g., by light or by the action of an enzyme. E may be —$NO_2$ or glucuronic acid (e.g., (3-glucuronic acid). The former may be susceptible to the action of a nitroreductase, the latter to the action of a β-glucuronidase.

The group Y may be a covalent bond.

The group Y may be a functional group selected from:
—C(=O)—
—NH—
—O—
—C(=O)NH—,
—C(=O)O—,
—NHC(=O)—,
—OC(=O)—,
—OC(=O)O—,
—NHC(=O)O—,
—OC(=O)NH—,
—NHC(=O)NH—,
—NHC(=O)NH,
—C(=O)NHC(=O)—,
$SO_2$, and
—S—.

The group Y is preferably —NH—, —CH₂—, —O—, and —S—.

In some embodiments, L¹ and L² together with —OC(=O)— represent:

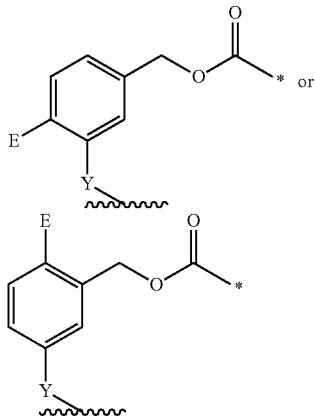 * or where the asterisk indicates the point of attachment to the Drug unit, the wavy line indicates the point of attachment to A, Y is a covalent bond or a functional group and E is glucuronic acid (e.g., β-glucuronic acid). Y is preferably a functional group selected from —NH—.

In some embodiments, L¹ and L² together represent:

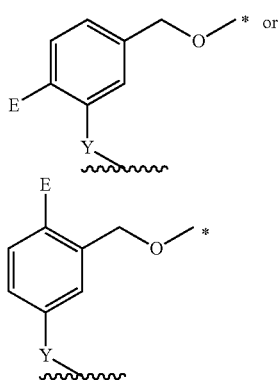 * or where the asterisk indicates the point of attachment to the remainder of L² or the Drug unit, the wavy line indicates the point of attachment to A¹, Y is a covalent bond or a functional group and E is glucuronic acid (e.g., β-glucuronic acid). Y is preferably a functional group selected from —NH—, —CH₂—, —O—, and —S—.

In some further embodiments, Y is a functional group as set forth above, the functional group is linked to an amino acid, and the amino acid is linked to the Stretcher unit A¹. In some embodiments, amino acid is β-alanine. In such an embodiment, the amino acid is equivalently considered part of the Stretcher unit.

The Specificity unit L¹ and the Ligand unit are indirectly connected via the Stretcher unit.

L¹ and A¹ may be connected by a bond selected from:
—C(=O)NH—,
—C(=O)O—,
—NHC(=O)—,
—OC(=O)—,
—OC(=O)O—,
—NHC(=O)O—,
—OC(=O)NH—, and
—NHC(=O)NH—.

In one embodiment, the group A¹ is:

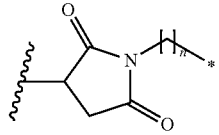

where the asterisk indicates the point of attachment to L¹, the wavy line indicates the point of attachment to the Ligand unit, and n is 0 to 6. In one embodiment, n is 5.

In one embodiment, the group A¹ is:

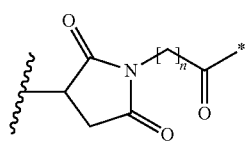

where the asterisk indicates the point of attachment to L¹, the wavy line indicates the point of attachment to the Ligand unit, and n is 0 to 6. In one embodiment, n is 5.

In one embodiment, the group A¹ is:

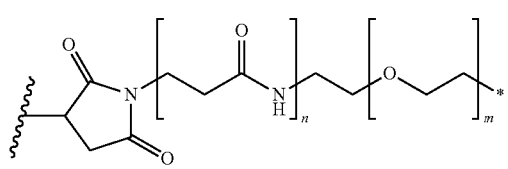

where the asterisk indicates the point of attachment to L¹, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.

In one embodiment, the group A¹ is:

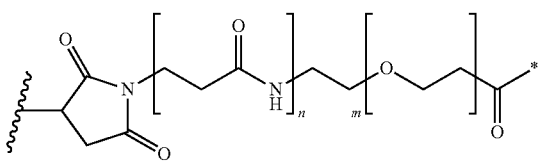

where the asterisk indicates the point of attachment to L¹, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.

In one embodiment, the group A¹ is:

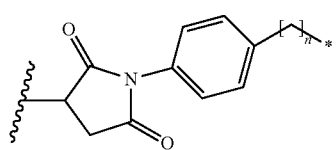

where the asterisk indicates the point of attachment to $L^1$, the wavy line indicates the point of attachment to the Ligand unit, and n is 0 to 6. In one embodiment, n is 5. In one embodiment, the group $A^1$ is:

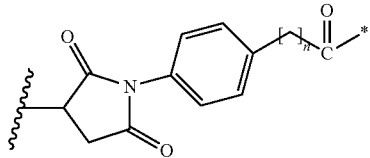

where the asterisk indicates the point of attachment to $L^1$, the wavy line indicates the point of attachment to the Ligand unit, and n is 0 to 6. In one embodiment, n is 5. In one embodiment, the group $A^1$ is:

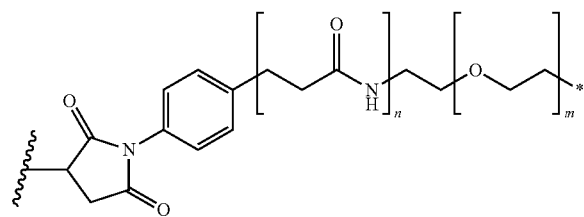

where the asterisk indicates the point of attachment to $L^1$, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.
In one embodiment, the group $A^1$ is:

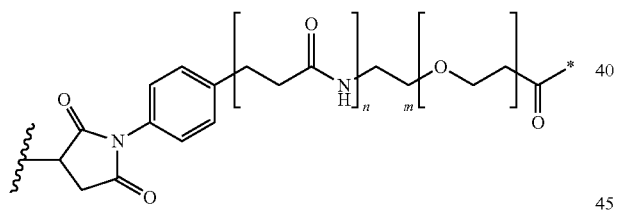

where the asterisk indicates the point of attachment to $L^1$, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.
In one embodiment, the connection between the Ligand unit and $A^1$ is through a thiol residue of the Ligand unit and a maleimide group of $A^1$.
In one embodiment, the connection between the Ligand unit and $A^1$ is:

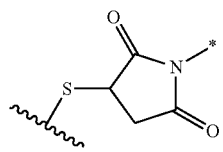

where the asterisk indicates the point of attachment to the remaining portion of $A^1$, $L^1$, $L^2$ or D, and the wavy line indicates the point of attachment to the remaining portion of the Ligand unit. In this embodiment, the S atom is typically derived from the Ligand unit.

In each of the embodiments above, an alternative functionality may be used in place of the malemide-derived group shown below:

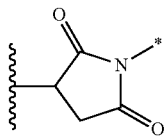 [SMILES: *C1CC(=O)N(*)C1=O]

where the wavy line indicates the point of attachment to the Ligand unit as before, and the asterisk indicates the bond to the remaining portion of the $A^1$ group, or to $L^1$, $L^2$ or D.

In one embodiment, the maleimide-derived group is replaced with the group:

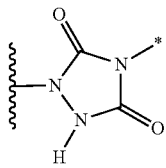 [SMILES: *n1[nH]c(=O)n(*)c1=O]

where the wavy line indicates point of attachment to the Ligand unit, and the asterisk indicates the bond to the remaining portion of the $A^1$ group, or to $L^1$, $L^2$ or D.

In one embodiment, the maleimide-derived group is replaced with a group, which optionally together with a Ligand unit (e.g., a Cell Binding Agent), is selected from:
—C(=O)NH—,
—C(=O)O—,
—NHC(=O)—,
—OC(=O)—,
—OC(=O)O—,
—NHC(=O)O—,
—OC(=O)NH—,
—NHC(=O)NH—,
—NHC(=O)NH,
—C(=O)NHC(=O)—,
—S—,
—S—S—,
—CH$_2$C(=O)—
—C(=O)CH$_2$—,
=N—NH—, and
—NH—N=.
Of these —C(=O)CH$_2$— may be preferred especially when the carbonyl group is bound to —NH—.
In one embodiment, the maleimide-derived group is replaced with a group, which optionally together with the Ligand unit, is selected from:

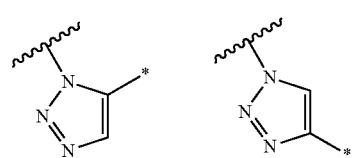 [SMILES: *c1cnnn1* ; *c1cn(*)nn1]

where the wavy line indicates either the point of attachment to the Ligand unit or the bond to the remaining portion of the $A^1$ group, and the asterisk indicates the other of the point of attachment to the Ligand unit or the bond to the remaining portion of the $A^1$ group.

Other groups suitable for connecting $L^1$ to the Cell Binding Agent are described in WO 2005/082023.

In one embodiment, the Stretcher unit $A^1$ is present, the Specificity unit $L^1$ is present and Spacer unit $L^2$ is absent. Thus, $L^1$ and the Drug unit are directly connected via a bond. Equivalently in this embodiment, $L^2$ is a bond.

$L^1$ and D may be connected by a bond selected from:
—C(=O)N<,
—C(=O)O—,
—NHC(=O)—,
—OC(=O)—,
—OC(=O)O—,
—NHC(=O)O—,
—OC(=O)N<, and
—NHC(=O)N<,
where N< or O— are part of D.

In one embodiment, $L^1$ and D are preferably connected by a bond selected from:
—C(=O)N<, and
—NHC(=O)—.

In one embodiment, $L^1$ comprises a dipeptide and one end of the dipeptide is linked to D. As described above, the amino acids in the dipeptide may be any combination of natural amino acids and non-natural amino acids. In some embodiments, the dipeptide comprises natural amino acids. Where the linker is a cathepsin labile linker, the dipeptide is the site of action for cathepsin-mediated cleavage. The dipeptide then is a recognition site for cathepsin.

In one embodiment, the group —$X_1$—$X_2$— in dipeptide, —NH—$X_1$—$X_2$—CO—, is selected from:
-Phe-Lys-,
-Val-Ala-,
-Val-Lys-,
-Ala-Lys-,
-Val-Cit-,
-Phe-Cit-,
-Leu-Cit-,
-Ile-Cit-,
-Phe-Arg-, and
-Trp-Cit-;
where Cit is citrulline. In such a dipeptide, —NH— is the amino group of $X_1$, and CO is the carbonyl group of $X_2$.

Preferably, the group —$X_1$—$X_2$— in dipeptide, —NH—$X_1$—$X_2$—CO—, is selected from:
-Phe-Lys-,
-Val-Ala-,
-Val-Lys-,
-Ala-Lys-, and
-Val-Cit-.

Most preferably, the group —$X_1$—$X_2$— in dipeptide, —NH—$X_1$—$X_2$—CO—, is -Phe-Lys- or -Val-Ala-.

Other dipeptide combinations of interest include:
-Gly-Gly-,
-Pro-Pro-, and
-Val-Glu-.

Other dipeptide combinations may be used, including those described above.

In one embodiment, $L^1$-D is:

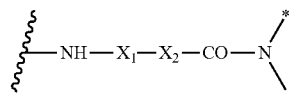

where —NH—$X_1$—$X_2$—CO is the dipeptide, —N< is part of the Drug unit, the asterisk indicates the points of attachment to the remainder of the Drug unit, and the wavy line indicates the point of attachment to the remaining portion of $L^1$ or the point of attachment to $A^1$. Preferably, the wavy line indicates the point of attachment to $A^1$.

In one embodiment, the dipeptide is valine-alanine and $L^1$-D is:

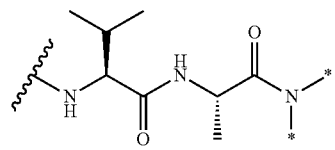 [SMILES: *N[C@H](C(=O)N[C@@H](C)C(=O)N(*)*)C(C)C]

where the asterisks, —N< and the wavy line are as defined above.

In one embodiment, the dipeptide is phenylalnine-lysine and $L^1$-D is:

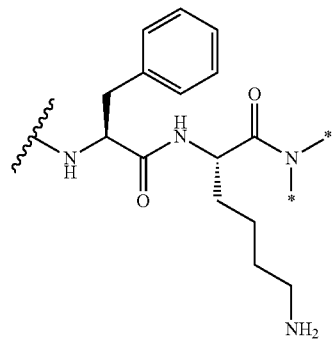 [SMILES: *N[C@@H](Cc1ccccc1)C(=O)N[C@@H](CCCCN)C(=O)N(*)*]

where the asterisks, —N< and the wavy line are as defined above.

In one embodiment, the dipeptide is valine-citrulline.

In one embodiment, the groups $A^1$-$L^1$ are:

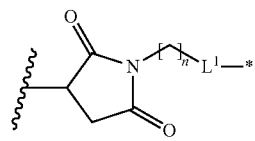

where the asterisk indicates the point of attachment to $L^2$ or D, the wavy line indicates the point of attachment to the Ligand unit, and n is 0 to 6. In one embodiment, n is 5.

In one embodiment, the groups $A^1$-$L^1$ are:

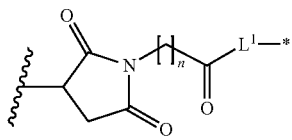

where the asterisk indicates the point of attachment to $L^2$ or D, the wavy line indicates the point of attachment to the Ligand unit, and n is 0 to 6. In one embodiment, n is 5.

In one embodiment, the groups $A^1$-$L^1$ are:

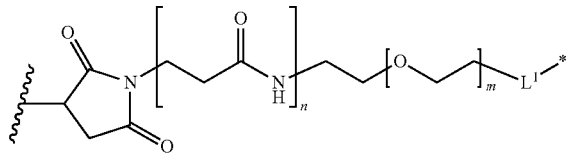

where the asterisk indicates the point of attachment to $L^2$ or D, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.

In one embodiment, the groups $A^1$-$L^1$ are:

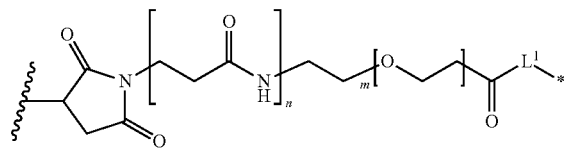

where the asterisk indicates the point of attachment to $L^2$ or D, the wavy line indicates the point of attachment to the Ligand unit, n is 0 or 1, and m is 0 to 30. In a preferred embodiment, n is 1 and m is 0 to 10, 1 to 7, preferably 3 to 7, most preferably 3 or 7.

In one embodiment, the groups $A^1$-$L^1$ are:

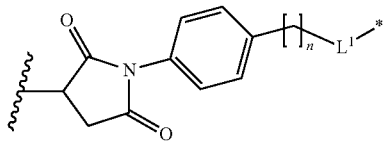

where the asterisk indicates the point of attachment to $L^2$ or D, the wavy line indicates the point of attachment to the Ligand unit, and n is 0 to 6. In one embodiment, n is 5.

In one embodiment, the groups $A^1$-$L^1$ are:

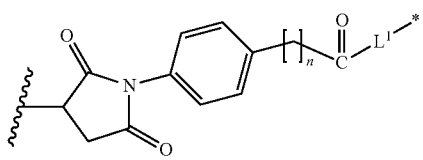

where the asterisk indicates the point of attachment to $L^2$ or D, the wavy line indicates the point of attachment to the Ligand unit, and n is 0 to 6. In one embodiment, n is 5.

In one embodiment, the groups $A^1$-$L^1$ are:

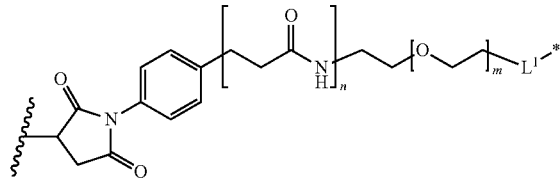

where the asterisk indicates the point of attachment to $L^2$ or D, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.

In one embodiment, the groups $A^1$-$L^1$ is:

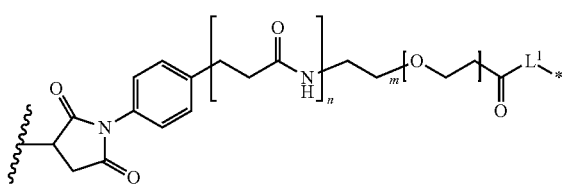

where the asterisk indicates the point of attachment to $L^2$ or D, the wavy line indicates the point of attachment to the Ligand unit, n is 0 or 1, and m is 0 to 30. In a preferred embodiment, n is 1 and m is 0 to 10, 1 to 8, preferably 4 to 8, most preferably 4 or 8.

In one embodiment, the groups L-$A^1$-$L^1$ are:

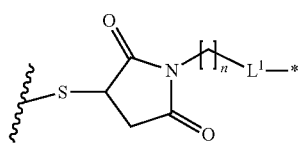

where the asterisk indicates the point of attachment to $L^2$ or D, S is a sulfur group of the Ligand unit, the wavy line indicates the point of attachment to the rest of the Ligand unit, and n is 0 to 6. In one embodiment, n is 5.

In one embodiment, the group L-$A^1$-$L^1$ are:

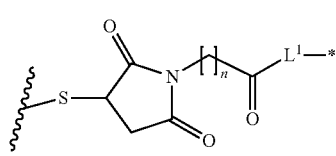

where the asterisk indicates the point of attachment to $L^2$ or D, S is a sulfur group of the Ligand unit, the wavy line indicates the point of attachment to the remainder of the Ligand unit, and n is 0 to 6. In one embodiment, n is 5.

In one embodiment, the groups L-A¹-L¹ are:

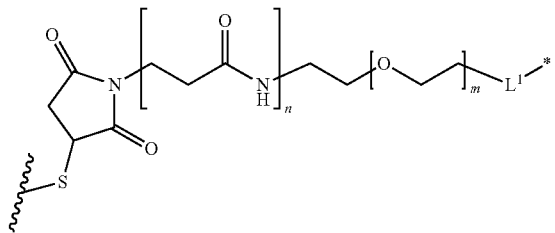

where the asterisk indicates the point of attachment to L² or D, S is a sulfur group of the Ligand unit, the wavy line indicates the point of attachment to the remainder of the Ligand unit, n is 0 or 1, and m is 0 to 30. In a preferred embodiment, n is 1 and m is 0 to 10, 1 to 8, preferably 4 to 8, most preferably 4 or 8.

In one embodiment, the groups L-A¹-L¹ are:

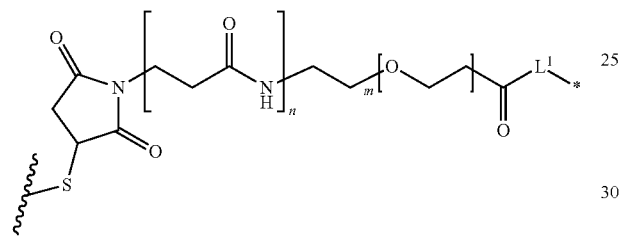

where the asterisk indicates the point of attachment to L² or D, the wavy line indicates the point of attachment to the Ligand unit, n is 0 or 1, and m is 0 to 30. In a preferred embodiment, n is 1 and m is 0 to 10, 1 to 7, preferably 4 to 8, most preferably 4 or 8.

In one embodiment, the groups L-A¹-L¹ are:

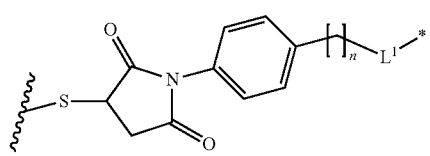

where the asterisk indicates the point of attachment to L² or D, the wavy line indicates the point of attachment to the remainder of the Ligand unit, and n is 0 to 6. In one embodiment, n is 5.

In one embodiment, the groups L-A¹-L¹ are:

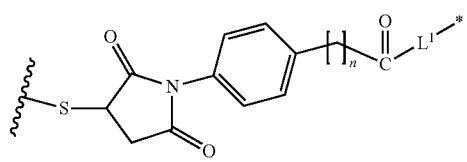

where the asterisk indicates the point of attachment to L² or D, the wavy line indicates the point of attachment to the remainder of the Ligand unit, and n is 0 to 6. In one embodiment, n is 5.

In one embodiment, the groups L-A¹-L¹ are:

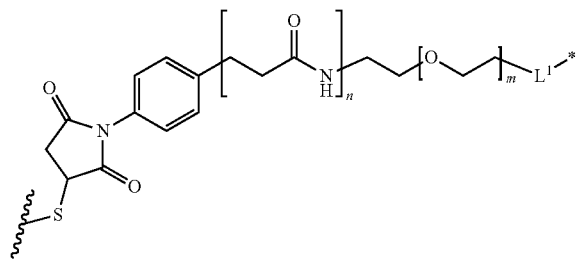

where the asterisk indicates the point of attachment to L² or D, the wavy line indicates the point of attachment to the remainder of the Ligand unit, n is 0 or 1, and m is 0 to 30. In a preferred embodiment, n is 1 and m is 0 to 10, 1 to 8, preferably 4 to 8, most preferably 4 or 8.

In one embodiment, the groups L-A¹-L¹ are:

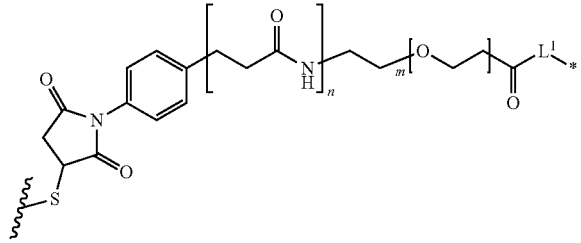

where the asterisk indicates the point of attachment to L² or D, the wavy line indicates the point of attachment to the remainder of the Ligand unit, n is 0 or 1, and m is 0 to 30. In a preferred embodiment, n is 1 and m is 0 to 10, 1 to 8, preferably 4 to 8, most preferably 4 or 8.

In one embodiment, the Stretcher unit is an acetamide unit, having the formula:

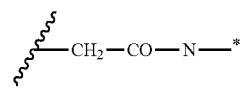

where the asterisk indicates the point of attachment to the remainder of the Stretcher unit, L¹ or D, and the wavy line indicates the point of attachment to the Ligand unit.

Linker-Drugs

In other embodiments, Linker-Drug compounds are provided for conjugation to a Ligand unit. In one embodiment, the Linker-Drug compounds are designed for connection to a Cell Binding Agent.

In one embodiment, the Drug Linker compound has the formula:

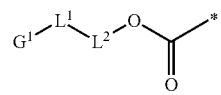

where the asterisk indicates the point of attachment to the Drug unit (D, as defined above), G¹ is a Stretcher group (A¹) to form a connection to a Ligand unit, L¹ is a Specificity unit, $L^2$ (a Spacer unit) is a covalent bond or together with —OC(=O)— forms a self-immolative group(s).

In another embodiment, the Drug Linker compound has the formula:

$G^1$-$L^1$-$L^2$-* where the asterisk indicates the point of attachment to the Drug unit (D), $G^1$ is a Stretcher unit ($A^1$) to form a connection to a Ligand unit, $L^1$ is a Specificity unit, $L^2$ (a Spacer unit) is a covalent bond or a self-immolative group(s).

$L^1$ and $L^2$ are as defined above. References to connection to $A^1$ can be construed here as referring to a connection to $G^1$.

In one embodiment, where $L^1$ comprises an amino acid, the side chain of that amino acid may be protected. Any suitable protecting group may be used. In one embodiment, the side chain protecting groups are removable with other protecting groups in the compound, where present. In other embodiments, the protecting groups may be orthogonal to other protecting groups in the molecule, where present.

Suitable protecting groups for amino acid side chains include those groups described in the Novabiochem Catalog 2006/2007. Protecting groups for use in a cathepsin labile linker are also discussed in Dubowchik et al.

In certain embodiments of the invention, the group $L^1$ includes a Lys amino acid residue. The side chain of this amino acid may be protected with a Boc or Alloc protected group. A Boc protecting group is most preferred.

The functional group $G^1$ forms a connecting group upon reaction with a Ligand unit (e.g., a cell binding agent).

In one embodiment, the functional group $G^1$ is or comprises an amino, carboxylic acid, hydroxy, thiol, or maleimide group for reaction with an appropriate group on the Ligand unit. In a preferred embodiment, $G^1$ comprises a maleimide group.

In one embodiment, the group $G^1$ is an alkyl maleimide group. This group is suitable for reaction with thiol groups, particularly cysteine thiol groups, present in the cell binding agent, for example present in an antibody.

In one embodiment, the group $G^1$ is:

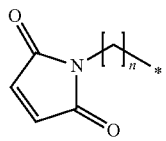

where the asterisk indicates the point of attachment to $L^1$, $L^2$ or D, and n is 0 to 6. In one embodiment, n is 5.

In one embodiment, the group $G^1$ is:

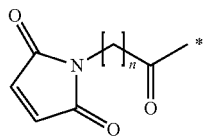

where the asterisk indicates the point of attachment to $L^1$, $L^2$ or D, and n is 0 to 6. In one embodiment, n is 5.

In one embodiment, the group $G^1$ is:

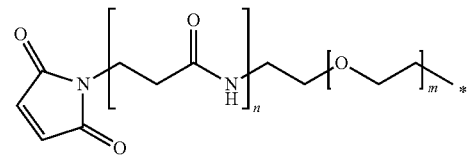

where the asterisk indicates the point of attachment to $L^1$, n is 0 or 1, and m is 0 to 30. In a preferred embodiment, n is 1 and m is 0 to 10, 1 to 2, preferably 4 to 8, and most preferably 4 or 8.

In one embodiment, the group $G^1$ is:

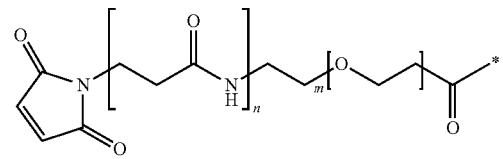

where the asterisk indicates the point of attachment to $L^1$, n is 0 or 1, and m is 0 to 30. In a preferred embodiment, n is 1 and m is 0 to 10, 1 to 8, preferably 4 to 8, and most preferably 4 or 8.

In one embodiment, the group $G^1$ is:

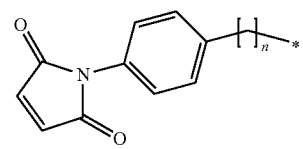

where the asterisk indicates the point of attachment to $L^1$, $L^2$ or D, and n is 0 to 6. In one embodiment, n is 5.

In one embodiment, the group $G^1$ is:

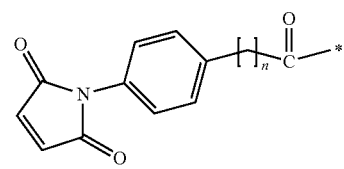

where the asterisk indicates the point of attachment to $L^1$, $L^2$ or D, and n is 0 to 6. In one embodiment, n is 5.

In one embodiment, the group $G^1$ is:

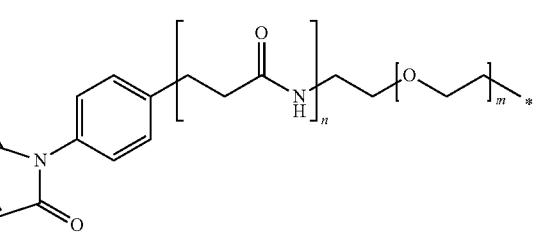

where the asterisk indicates the point of attachment to $L^1$, n is 0 or 1, and m is 0 to 30. In a preferred embodiment, n is 1 and m is 0 to 10, 1 to 2, preferably 4 to 8, and most preferably 4 or 8.

In one embodiment, the group $G^1$ is:

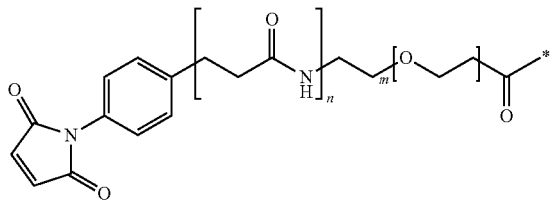

where the asterisk indicates the point of attachment to $L^1$, n is 0 or 1, and m is 0 to 30. In a preferred embodiment, n is 1 and m is 0 to 10, 1 to 8, preferably 4 to 8, and most preferably 4 or 8.

In each of the embodiments above, an alternative functionality may be used in place of the malemide group shown below:

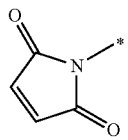

where the asterisk indicates the bond to the remaining portion of the G group.

In one embodiment, the maleimide-derived group is replaced with the group:

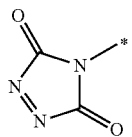

where the asterisk indicates the bond to the remaining portion of the G group.

In one embodiment, the maleimide group is replaced with a group selected from:
—C(═O)OH,
—OH,
—NH$_2$,
—SH,
—C(═O)CH$_2$X, where X is Cl, Br or I,
—CHO,
—NHNH$_2$
—C≡CH, and
—N$_3$ (azide).

Of these, —C(═O)CH$_2$X may be preferred, especially when the carbonyl group is bound to —NH—.

In one embodiment, $L^1$ is present, and $G^1$ is —NH$_2$, —NHMe, —COOH, —OH or —SH.

In one embodiment, where $L^1$ is present, $G^1$ is —NH$_2$ or —NHMe. Either group may be the N-terminal of an $L^1$ amino acid sequence.

In one embodiment, $L^1$ is present and $G^1$ is —NH$_2$, and $L^1$ is an amino acid sequence —X$_1$—X$_2$—, as defined above.

In one embodiment, $L^1$ is present and $G^1$ is COOH. This group may be the C-terminal of an $L^1$ amino acid sequence.

In one embodiment, $L^1$ is present and $G^1$ is OH.

In one embodiment, $L^1$ is present and $G^1$ is SH.

The group $G^1$ may be convertable from one functional group to another. In one embodiment, $L^1$ is present and $G^1$ is —NH$_2$. This group is convertable to another group $G^1$ comprising a maleimide group. For example, the group —NH$_2$ may be reacted with an acids or an activated acid (e.g., N-succinimide forms) of those $G^1$ groups comprising maleimide shown above.

The group $G^1$ may therefore be converted to a functional group that is more appropriate for reaction with a Ligand unit.

As noted above, in one embodiment, $L^1$ is present and $G^1$ is —NH$_2$, —NHMe, —COOH, —OH or —SH. In a further embodiment, these groups are provided in a chemically protected form. The chemically protected form is therefore a precursor to the linker that is provided with a functional group.

In one embodiment, $G^1$ is —NH$_2$ in a chemically protected form. The group may be protected with a carbamate protecting group. The carbamate protecting group may be selected from the group consisting of:

Alloc, Fmoc, Boc, Troc, Teoc, Cbz and PNZ.

Preferably, where $G^1$ is —NH$_2$, it is protected with an Alloc or Fmoc group.

In one embodiment, where $G^1$ is —NH$_2$, it is protected with an Fmoc group.

In one embodiment, the protecting group is the same as the carbamate protecting group of the capping group.

In one embodiment, the protecting group is not the same as the carbamate protecting group of the capping group. In this embodiment, it is preferred that the protecting group is removable under conditions that do not remove the carbamate protecting group of the capping group.

The chemical protecting group may be removed to provide a functional group to form a connection to a Ligand unit. Optionally, this functional group may then be converted to another functional group as described above.

In one embodiment, the active group is an amine. This amine is preferably the N-terminal amine of a peptide, and may be the N-terminal amine of the preferred dipeptides of the invention.

The active group may be reacted to yield the functional group that is intended to form a connection to a Ligand unit.

In other embodiments, the Linker unit is a precursor to the Linker unit having an active group. In this embodiment, the Linker unit comprises the active group, which is protected by way of a protecting group. The protecting group may be removed to provide the Linker unit having an active group.

Where the active group is an amine, the protecting group may be an amine protecting group, such as those described in Green and Wuts.

The protecting group is preferably orthogonal to other protecting groups, where present, in the Linker unit.

In one embodiment, the protecting group is orthogonal to the capping group. Thus, the active group protecting group is removable whilst retaining the capping group. In other embodiments, the protecting group and the capping group is removable under the same conditions as those used to remove the capping group.

In one embodiment, the Linker unit is:

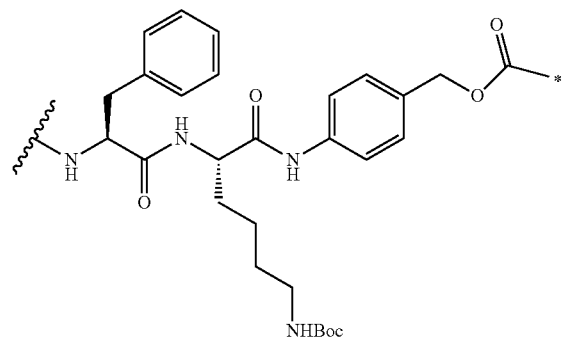 [SMILES: *N[C@@H](Cc1ccccc1)C(=O)N[C@@H](CCCCNC(=O)OC(C)(C)C)C(=O)Nc1ccc(COC(C)=O)cc1]

where the asterisk indicates the point of attachment to the Drug unit, and the wavy line indicates the point of attachment to the remaining portion of the Linker unit, as applicable or the point of attachment to $G^1$. Preferably, the wavy line indicates the point of attachment to $G^1$.

In one embodiment, the Linker unit is:

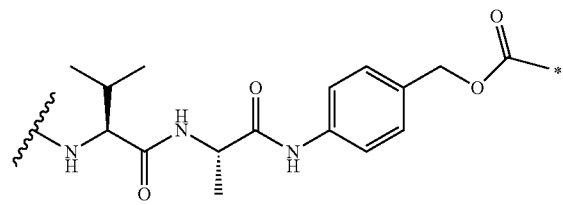 [SMILES: *N[C@H](C(=O)N[C@@H](C)C(=O)Nc1ccc(COC(C)=O)cc1)C(C)C]

where the asterisk and the wavy line are as defined above.

Other functional groups suitable for use in forming a connection between $L^1$ and the Cell Binding Agent are described in WO 2005/082023.

Ligand Unit

The Ligand Unit may be of any kind, and include a protein, polypeptide, peptide and a non-peptidic agent that specifically binds to a target molecule. In some embodiments, the Ligand unit may be a protein, polypeptide or peptide. In some embodiments, the Ligand unit may be a cyclic polypeptide. These Ligand units can include antibodies or a fragment of an antibody that contains at least one target molecule-binding site, lymphokines, hormones, growth factors, or any other cell binding molecule or substance that can specifically bind to a target. The ligand Unit is also referred to herein as a "binding agent" or "targeting agent".

The terms "specifically binds" and "specific binding" refer to the binding of an antibody or other protein, polypeptide or peptide to a predetermined molecule (e.g., an antigen). Typically, the antibody or other molecule binds with an affinity of at least about $1 \times 10^7$ $M^{-1}$, and binds to the predetermined molecule with an affinity that is at least two-fold greater than its affinity for binding to a non-specific molecule (e.g., BSA, casein) other than the predetermined molecule or a closely-related molecule.

Examples of Ligand units include those agents described for use in WO 2007/085930, which is incorporated herein.

In some embodiments, the Ligand unit is a Cell Binding Agent that binds to an extracellular target on a cell. Such a Cell Binding Agent can be a protein, polypeptide, peptide or a non-peptidic agent. In some embodiments, the Cell Binding Agent may be a protein, polypeptide or peptide. In some embodiments, the Cell Binding Agent may be a cyclic polypeptide. The Cell Binding Agent also may be antibody or an antigen-binding fragment of an antibody. Thus, in one embodiment, the present invention provides an antibody-drug conjugate (ADC).

Peptides

In one embodiment, the cell binding agent is a linear or cyclic peptide comprising 4-30, preferably 6-20, contiguous amino acid residues. In this embodiment, it is preferred that one cell binding agent is linked to one monomer or dimer pyrrolobenzodiazepine compound.

In one embodiment the cell binding agent comprises a peptide that binds integrin $\alpha_v\beta_6$. The peptide may be selective for $\alpha_v\beta_6$ over XYS.

In one embodiment the cell binding agent comprises the A20FMDV-Cys polypeptide. The A20FMDV-Cys has the sequence: NAVPNLRGDLQVLAQKVARTC. Alternatively, a variant of the A20FMDV-Cys sequence may be used wherein one, two, three, four, five, six, seven, eight, nine or ten amino acid residues are substituted with another amino acid residue. Furthermore, the polypeptide may have the sequence NAVXXXXXXXXXXXXXXXXRTC.

Antibodies

The term "antibody" herein is used in the broadest sense and specifically covers monoclonal antibodies, polyclonal antibodies, dimers, multimers, multispecific antibodies (e.g., bispecific antibodies), and antibody fragments, so long as they exhibit the desired biological activity (Miller et al (2003) *Jour. of Immunology* 170:4854-4861). Antibodies may be murine, human, humanized, chimeric, or derived from other species. An antibody is a protein generated by the immune system that is capable of recognizing and binding to a specific antigen. (Janeway, C., Travers, P., Walport, M., Shlomchik (2001) *Immuno Biology*, 5th Ed., Garland Publishing, New York). A target antigen generally has numerous binding sites, also called epitopes, recognized by CDRs on multiple antibodies. Each antibody that specifically binds to a different epitope has a different structure. Thus, one antigen may have more than one corresponding antibody. An antibody includes a full-length immunoglobulin molecule or an immunologically active portion of a full-length immunoglobulin molecule, i.e., a molecule that contains an antigen binding site that immunospecifically binds an antigen of a target of interest or part thereof, such targets including but not limited to, cancer cell or cells that produce autoimmune antibodies associated with an autoimmune disease. The immunoglobulin can be of any type (e.g. IgG, IgE, IgM, IgD, and IgA), class (e.g. IgG1, IgG2, IgG3, IgG4, IgA1 and IgA2) or subclass of immunoglobulin molecule. The immunoglobulins can be derived from any species, including human, murine, or rabbit origin.

"Antibody fragments" comprise a portion of a full length antibody, generally the antigen binding or variable region thereof. Examples of antibody fragments include Fab, Fab', F(ab')$_2$, and scFv fragments; diabodies; linear antibodies; fragments produced by a Fab expression library, anti-idiotypic (anti-Id) antibodies, CDR (complementary determining region), and epitope-binding fragments of any of the above which immunospecifically bind to cancer cell antigens, viral antigens or microbial antigens, single-chain antibody molecules; and multispecific antibodies formed from antibody fragments.

The term "monoclonal antibody" as used herein refers to an antibody obtained from a population of substantially homogeneous antibodies, i.e. the individual antibodies comprising the population are identical except for possible naturally occurring mutations that may be present in minor amounts. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al (1975) Nature 256:495, or may be made by recombinant DNA methods (see, U.S. Pat. No. 4,816,567). The monoclonal antibodies may also be isolated from phage antibody libraries using the techniques described in Clackson et al (1991) Nature, 352:624-628; Marks et al (1991) J. Mol. Biol., 222:581-597 or from transgenic mice carrying a fully human immunoglobulin system (Lonberg (2008) Curr. Opinion 20(4):450-459).

The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al (1984) Proc. Natl. Acad. Sci. USA, 81:6851-6855). Chimeric antibodies include "primatized" antibodies comprising variable domain antigen-binding sequences derived from a non-human primate (e.g. Old World Monkey or Ape) and human constant region sequences.

An "intact antibody" herein is one comprising a VL and VH domains, as well as a light chain constant domain (CL) and heavy chain constant domains, CH1, CH2 and CH3. The constant domains may be native sequence constant domains (e.g. human native sequence constant domains) or amino acid sequence variant thereof. The intact antibody may have one or more "effector functions" which refer to those biological activities attributable to the Fc region (a native sequence Fc region or amino acid sequence variant Fc region) of an antibody. Examples of antibody effector functions include C1q binding; complement dependent cytotoxicity; Fc receptor binding; antibody-dependent cell-mediated cytotoxicity (ADCC); phagocytosis; and down regulation of cell surface receptors such as B cell receptor and BCR.

Depending on the amino acid sequence of the constant domain of their heavy chains, intact antibodies can be assigned to different "classes." There are five major classes of intact antibodies: IgA, IgD, IgE, IgG, and IgM, and several of these may be further divided into "subclasses" (isotypes), e.g., IgG1, IgG2, IgG3, IgG4, IgA, and IgA2. The heavy-chain constant domains that correspond to the different classes of antibodies are called α, δ, ε, γ, and μ, respectively. The subunit structures and three-dimensional configurations of different classes of immunoglobulins are well known.

Humanization

Techniques to reduce the in vivo immunogenicity of a non-human antibody or antibody fragment include those termed "humanization".

A "humanized antibody" refers to a polypeptide comprising at least a portion of a modified variable region of a human antibody wherein a portion of the variable region, preferably a portion substantially less than the intact human variable domain, has been substituted by the corresponding sequence from a non-human species and wherein the modified variable region is linked to at least another part of another protein, preferably the constant region of a human antibody. The expression "humanized antibodies" includes human antibodies in which one or more complementarity determining region ("CDR") amino acid residues and/or one or more framework region ("FW" or "FR") amino acid residues are substituted by amino acid residues from analogous sites in rodent or other non-human antibodies. The expression "humanized antibody" also includes an immunoglobulin amino acid sequence variant or fragment thereof that comprises an FR having substantially the amino acid sequence of a human immunoglobulin and a CDR having substantially the amino acid sequence of a non-human immunoglobulin.

"Humanized" forms of non-human (e.g., murine) antibodies are chimeric antibodies that contain minimal sequence derived from non-human immunoglobulin. Or, looked at another way, a humanized antibody is a human antibody that also contains selected sequences from non-human (e.g. murine) antibodies in place of the human sequences. A humanized antibody can include conservative amino acid substitutions or non-natural residues from the same or different species that do not significantly alter its binding and/or biologic activity. Such antibodies are chimeric antibodies that contain minimal sequence derived from non-human immunoglobulins.

There are a range of humanization techniques, including 'CDR grafting', 'guided selection', 'deimmunization', 'resurfacing' (also known as Veneering'), 'composite antibodies', 'Human String Content Optimisation' and framework shuffling.

CDR Grafting

In this technique, the humanized antibodies are human immunoglobulins (recipient antibody) in which residues from a complementary-determining region (CDR) of the recipient antibody are replaced by residues from a CDR of a non-human species (donor antibody) such as mouse, rat, camel, bovine, goat, or rabbit having the desired properties (in effect, the non-human CDRs are 'grafted' onto the human framework). In some instances, framework region (FR) residues of the human immunoglobulin are replaced by corresponding non-human residues (this may happen when, for example, a particular FR residue has significant effect on antigen binding).

Furthermore, humanized antibodies can comprise residues that are found neither in the recipient antibody nor in the imported CDR or framework sequences. These modifications are made to further refine and maximize antibody performance. Thus, in general, a humanized antibody will comprise all of at least one, and in one aspect two, variable domains, in which all or all of the hypervariable loops correspond to those of a non-human immunoglobulin and all or substantially all of the FR regions are those of a human immunoglobulin sequence. The humanized antibody optionally also will comprise at least a portion of an immunoglobulin constant region (Fc), or that of a human immunoglobulin.

Guided Selection

The method consists of combining the $V_H$ or $V_L$ domain of a given non-human antibody specific for a particular epitope with a human $V_H$ or $V_L$ library and specific human V domains are selected against the antigen of interest. This selected human VH is then combined with a VL library to generate a completely human VH×VL combination. The method is described in Nature Biotechnology (N.Y.) 12, (1994) 899-903.

Composite Antibodies

In this method, two or more segments of amino acid sequence from a human antibody are combined within the final antibody molecule. They are constructed by combining multiple human VH and VL sequence segments in combinations which limit or avoid human T cell epitopes in the final composite antibody V regions. Where required, T cell epitopes are limited or avoided by, exchanging V region segments contributing to or encoding a T cell epitope with alternative segments which avoid T cell epitopes. This method is described in US 2008/0206239 A1.

Deimmunization

This method involves the removal of human (or other second species) T-cell epitopes from the V regions of the therapeutic antibody (or other molecule). The therapeutic antibodies V-region sequence is analysed for the presence of MHC class II-binding motifs by, for example, comparison with databases of MHC-binding motifs (such as the "motifs" database hosted at www.wehi.edu.au). Alternatively, MHC class II-binding motifs may be identified using computational threading methods such as those devised by Altuvia et al. (J. Mol. Biol. 249 244-250 (1995)); in these methods, consecutive overlapping peptides from the V-region sequences are testing for their binding energies to MHC class II proteins. This data can then be combined with information on other sequence features which relate to successfully presented peptides, such as amphipathicity, Rothbard motifs, and cleavage sites for cathepsin B and other processing enzymes.

Once potential second species (e.g. human) T-cell epitopes have been identified, they are eliminated by the alteration of one or more amino acids. The modified amino acids are usually within the T-cell epitope itself, but may also be adjacent to the epitope in terms of the primary or secondary structure of the protein (and therefore, may not be adjacent in the primary structure). Most typically, the alteration is by way of substitution but, in some circumstances amino acid addition or deletion will be more appropriate.

All alterations can be accomplished by recombinant DNA technology, so that the final molecule may be prepared by expression from a recombinant host using well established methods such as Site Directed Mutagenesis. However, the use of protein chemistry or any other means of molecular alteration is also possible.

Resurfacing

This method involves:

(a) determining the conformational structure of the variable region of the non-human (e.g. rodent) antibody (or fragment thereof) by constructing a three-dimensional model of the non-human antibody variable region;

(b) generating sequence alignments using relative accessibility distributions from x-ray crystallographic structures of a sufficient number of non-human and human antibody variable region heavy and light chains to give a set of heavy and light chain framework positions wherein the alignment positions are identical in 98% of the sufficient number of non-human antibody heavy and light chains;

(c) defining for the non-human antibody to be humanized, a set of heavy and light chain surface exposed amino acid residues using the set of framework positions generated in step (b);

(d) identifying from human antibody amino acid sequences a set of heavy and light chain surface exposed amino acid residues that is most closely identical to the set of surface exposed amino acid residues defined in step (c), wherein the heavy and light chain from the human antibody are or are not naturally paired;

(e) substituting, in the amino acid sequence of the non-human antibody to be humanized, the set of heavy and light chain surface exposed amino acid residues defined in step (c) with the set of heavy and light chain surface exposed amino acid residues identified in step (d);

(f) constructing a three-dimensional model of the variable region of the non-human antibody resulting from the substituting specified in step (e);

(g) identifying, by comparing the three-dimensional models constructed in steps (a) and (f), any amino acid residues from the sets identified in steps (c) or (d), that are within 5 Angstroms of any atom of any residue of the complementarity determining regions of the non-human antibody to be humanized; and (h) changing any residues identified in step (g) from the human to the original non-human amino acid residue to thereby define a non-human antibody humanizing set of surface exposed amino acid residues; with the proviso that step (a) need not be conducted first, but must be conducted prior to step (g).

Superhumanization

The method compares the non-human sequence with the functional human germline gene repertoire. Those human genes encoding canonical structures identical or closely related to the non-human sequences are selected. Those selected human genes with highest homology within the CDRs are chosen as FR donors. Finally, the non-human CDRs are grafted onto these human FRs. This method is described in patent WO 2005/079479 A2.

Human String Content Optimization

This method compares the non-human (e.g. mouse) sequence with the repertoire of human germline genes and the differences are scored as Human String Content (HSC) that quantifies a sequence at the level of potential MHC/T-cell epitopes. The target sequence is then humanized by maximizing its HSC rather than using a global identity measure to generate multiple diverse humanized variants (described in Molecular Immunology, 44, (2007) 1986-1998).

Framework Shuffling

The CDRs of the non-human antibody are fused in-frame to cDNA pools encompassing all known heavy and light chain human germline gene frameworks. Humanised antibodies are then selected by e.g. panning of the phage displayed antibody library. This is described in *Methods* 36, 43-60 (2005).

Examples of cell binding agents include those agents described for use in WO 2007/085930, which is incorporated herein.

Tumour-associate antigens and cognate antibodies for use in embodiments of the present invention are listed below.

Tumor-Associated Antigens and Cognate Antibodies (1) BMPR1B (Bone Morphogenetic Protein Receptor-Type IB)
Nucleotide
Genbank accession no. NM_001203
Genbank version no. NM_001203.2 GI:169790809
Genbank record update date: Sep. 23, 2012 02:06 PM
Polypeptide
Genbank accession no. NP_001194
Genbank version no. NP_001194.1 GI:4502431
Genbank record update date: Sep. 23, 2012 02:06 PM
Cross-References
ten Dijke, P., et al *Science* 264 (5155): 101-104 (1994), *Oncogene* 14 10 (11):1377-1382 (1997)); WO2004/063362 (Claim 2); WO2003/042661 (Claim 12); US2003/134790-A1 (Page 38-39); WO2002/102235 (Claim 13; Page 296); WO2003/055443 (Page 91-92); WO2002/99122 (Example 2; Page 528-530); WO2003/029421 (Claim 6); WO2003/024392 (Claim 2; FIG. 112); WO2002/98358 (Claim 1; Page 183); WO2002/54940 (Page 100-101); WO2002/59377 (Page 349-350); WO2002/30268 (Claim 27; Page 376); 15 WO2001/48204 (Example; FIG. 4); NP_001194 bone morphogenetic protein receptor, type IB/pid=NP_001194.1; MIM: 603248; AY065994

(2) E16 (LAT1, SLC7A5)
Nucleotide
Genbank accession no. NM_003486
Genbank version no. NM_003486.5 GI:71979931
Genbank record update date: Jun. 27, 2012 12:06 PM
Polypeptide
Genbank accession no. NP_003477
Genbank version no. NP_003477.4 GI:71979932
Genbank record update date: Jun. 27, 2012 12:06 PM
Cross References
*Biochem. Biophys. Res. Commun.* 255 (2), 283-288 (1999), *Nature* 395 (6699):288-291 (1998), Gaugitsch, H. W., et 20 al (1992) *J. Biol. Chem.* 267 (16):11267-11273); WO2004/048938 (Example 2); WO2004/032842 (Example IV); WO2003/042661 (Claim 12); WO2003/016475 (Claim 1); WO2002/78524 (Example 2); WO2002/99074 (Claim 19; Page 127-129); WO2002/86443 (Claim 27; Pages 222, 393); WO2003/003906 (Claim 10; Page 293); WO2002/64798 (Claim 33; Page 93-95); WO2000/14228 (Claim 5; Page 133-136); US2003/224454 (FIG. 3); 25 WO2003/025138 (Claim 12; Page 150); NP_003477 solute carrier family 7 (cationic amino acid transporter, y+system), member 5/pid=NP_003477.3-*Homo sapiens*; MIM:600182; NM_015923.

(3) STEAP1 (Six Transmembrane Epithelial Antigen of Prostate)
Nucleotide
Genbank accession no. NM_012449
Genbank version no. NM_012449.2 GI:22027487
Genbank record update date: Sep. 9, 2012 02:57 PM
Polypeptide
Genbank accession no. NP_036581
Genbank version no. NP_036581.1 GI:9558759
Genbank record update date: Sep. 9, 2012 02:57 PM
Cross References
*Cancer Res.* 61 (15), 5857-5860 (2001), Hubert, R. S., et al (1999) *Proc. Natl. Acad. Sci. U.S.A.* 96 (25):14523-14528); WO2004/065577 (Claim 6); WO2004/027049 (FIG. 1L); EP1394274 (Example 11); WO2004/016225 (Claim 2); WO2003/042661 (Claim 12); US2003/157089 (Example 5); US2003/185830 (Example 5); US2003/064397 (FIG. 2); WO2002/89747 (Example 5; Page 618-619); WO2003/022995 (Example 9; FIG. 13A, 35 Example 53; Page 173, Example 2; FIG. 2A); six transmembrane epithelial antigen of the prostate; MIM: 604415.

(4) 0772P (CA125, MUC16)
Nucleotide
Genbank accession no. AF361486
Genbank version no. AF361486.3 GI:34501466
Genbank record update date: Mar. 11, 2010 07:56 AM
Polypeptide
Genbank accession no. AAK74120
Genbank version no. AAK74120.3 GI:34501467
Genbank record update date: Mar. 11, 2010 07:56 AM
Cross References
*J. Biol. Chem.* 276 (29):27371-27375 (2001)); WO2004/045553 (Claim 14); WO2002/92836 (Claim 6; FIG. 12); WO2002/83866 (Claim 15; Page 116-121); US2003/124140 (Example 16); GI:34501467;

(5) MPF (MPF, MSLN, SMR, Megakaryocyte Potentiating Factor, Mesothelin)
Nucleotide
Genbank accession no. NM_005823
Genbank version no. NM_005823.5 GI:293651528
Genbank record update date: Sep. 2, 2012 01:47 PM
Polypeptide
Genbank accession no. NP_005814
Genbank version no. NP_005814.2 GI:53988378
Genbank record update date: Sep. 2, 2012 01:47 PM
Cross References
Yamaguchi, N., et al *Biol. Chem.* 269 (2), 805-808 (1994), *Proc. Natl. Acad. Sci. U.S.A.* 96 (20):11531-11536 (1999), *Proc. Natl. Acad. Sci. U.S.A.* 93 10 (1):136-140 (1996), *J. Biol. Chem.* 270 (37):21984-21990 (1995)); WO2003/101283 (Claim 14); (WO2002/102235 (Claim 13; Page 287-288); WO2002/101075 (Claim 4; Page 308-309); WO2002/71928 (Page 320-321); WO94/10312 (Page 52-57); IM:601051.

(6) Napi3b (NAPI-3B, NPTIIb, SLC34A2, Solute Carrier Family 34 (Sodium Phosphate), Member 2, Type II Sodium-Dependent Phosphate Transporter 3b)
Nucleotide
Genbank accession no. NM_006424
Genbank version no. NM_006424.2 GI:110611905
Genbank record update date: Jul. 22, 2012 03:39 PM
Polypeptide
Genbank accession no. NP_006415
Genbank version no. NP_006415.2 GI:110611906
Genbank record update date: Jul. 22, 2012 03:39 PM
Cross References
*J. Biol. Chem.* 277 (22):19665-19672 (2002), *Genomics* 62 (2):281-284 (1999), Feild, J. A., et al (1999) *Biochem. Biophys. Res. Commun.* 258 (3):578-582); WO2004/022778 (Claim 2); EP1394274 (Example 11); WO2002/102235 (Claim 13; Page 20 326); EP0875569 (Claim 1; Page 17-19); WO2001/57188 (Claim 20; Page 329); WO2004/032842 (Example IV); WO2001/75177 (Claim 24; Page 139-140); MIM:604217.

(7) Sema 5b (FLJ10372, KIAA1445, Mm.42015, SEMA5B, SEMAG, Semaphorin 5b Hlog, 25 Sema Domain, Seven Thrombospondin Repeats (Type 1 and Type 1-Like), Transmembrane Domain (TM) and Short Cytoplasmic Domain, (Semaphorin) 5B)
Nucleotide
Genbank accession no. AB040878
Genbank version no. AB040878.1 GI:7959148
Genbank record update date: Aug. 2, 2006 05:40 PM Polypeptide
Genbank accession no. BAA95969
Genbank version no. BAA95969.1 GI:7959149
Genbank record update date: Aug. 2, 2006 05:40 PM
Cross References
Nagase T., et al (2000) *DNA Res.* 7 (2):143-150); WO2004/000997 (Claim 1); WO2003/003984 (Claim 1); WO2002/06339 (Claim 1; Page 50); WO2001/88133 (Claim 1; Page 41-43, 48-58); WO2003/054152 (Claim 20); WO2003/101400 (Claim 11); Accession: 30 Q9P283; Genew; HGNC:10737

(8) PSCA hlg (2700050C12Rik, C530008O16Rik, RIKEN cDNA 2700050C12, RIKEN cDNA 2700050C12 Gene)
Nucleotide
Genbank accession no. AY358628
Genbank version no. AY358628.1 GI:37182377
Genbank record update date: Dec. 1, 2009 04:15 AM
Polypeptide
Genbank accession no. AAQ88991
Genbank version no. AAQ88991.1 GI:37182378
Genbank record update date: Dec. 1, 2009 04:15 AM
Cross References
Ross et al (2002) *Cancer Res.* 62:2546-2553; US2003/129192 (Claim 2); US2004/044180 (Claim 12); US2004/044179 35 (Claim 11); US2003/096961 (Claim 11); US2003/232056 (Example 5); WO2003/105758 16 (Claim 12); US2003/206918 (Example 5); EP1347046 (Claim 1); WO2003/025148 (Claim 20); GI:37182378.

(9) ETBR (Endothelin Type B Receptor)
Nucleotide
Genbank accession no. AY275463
Genbank version no. AY275463.1 GI:30526094
Genbank record update date: Mar. 11, 2010 02:26 AM
Polypeptide
Genbank accession no. AAP32295
Genbank version no. AAP32295.1 GI:30526095
Genbank record update date: Mar. 11, 2010 02:26 AM
Cross References
Nakamuta M., et al *Biochem. Biophys. Res. Commun.* 177, 34-39, 1991; Ogawa Y., et al *Biochem. Biophys. Res. Commun.* 178, 248-255, 1991; Arai H., et al *Jpn. Circ. J.* 56, 1303-1307, 1992; Arai H., et al *J. Biol. Chem.* 268, 3463-3470, 1993; Sakamoto A., Yanagisawa M., et al *Biochem. Biophys. Res. Commun.* 178, 656-663, 1991; Elshourbagy N. A., et al *J. Biol. Chem.* 268, 3873-3879, 1993; Haendler B., et al *J. Cardiovasc. Pharmacol.* 20, s1-S4, 1992; Tsutsumi M., et al *Gene* 228, 43-49, 1999; Strausberg R. L., et al *Proc. Natl. Acad. Sci. U.S.A.* 99, 16899-16903, 2002; Bourgeois C., et al *J. Clin. Endocrinol. Metab.* 82, 3116-3123, 1997;
Okamoto Y., et al *Biol. Chem.* 272, 21589-21596, 1997; Verheij J. B., et al *Am. J. Med. Genet.* 108, 223-225, 2002; Hofstra R. M. W., et al *Eur. J. Hum. Genet.* 5, 180-185, 1997; Puffenberger E. G., et al *Cell* 79, 1257-1266, 1994; Attie T., et al, *Hum. Mol. Genet.* 4, 2407-15 2409, 1995; Auricchio A., et al *Hum. Mol. Genet.* 5:351-354, 1996; Amiel J., et al *Hum. Mol. Genet.* 5, 355-357, 1996; Hofstra R. M. W., et al *Nat. Genet.* 12, 445-447, 1996; Svensson P. J., et al *Hum. Genet.* 103, 145-148, 1998; Fuchs S., et al *Mol. Med.* 7, 115-124, 2001; Pingault V., et al (2002) *Hum. Genet.* 111, 198-206; WO2004/045516 (Claim 1); WO2004/048938 (Example 2); WO2004/040000 (Claim 151); WO2003/087768 (Claim 1); 20 WO2003/016475 (Claim 1); WO2003/016475 (Claim 1); WO2002/61087 (FIG. 1); WO2003/016494 (FIG. 6); WO2003/025138 (Claim 12; Page 144); WO2001/98351 (Claim 1;
Page 124-125); EP0522868 (Claim 8; FIG. 2); WO2001/77172 (Claim 1; Page 297-299); US2003/109676; U.S. Pat. No. 6,518,404 (FIG. 3); U.S. Pat. No. 5,773,223 (Claim 1a; Col 31-34); WO2004/001004.

(10) MSG783 (RNF124, Hypothetical Protein FLJ20315)
Nucleotide
Genbank accession no. NM_017763
Genbank version no. NM_017763.4 GI:167830482
Genbank record update date: Jul. 22, 2012 12:34 AM
Polypeptide
Genbank accession no. NP_060233
Genbank version no. NP_060233.3 GI:56711322
Genbank record update date: Jul. 22, 2012 12:34 AM
Cross References
WO2003/104275 (Claim 1); WO2004/046342 (Example 2); WO2003/042661 (Claim 12); WO2003/083074 (Claim 14; Page 61); WO2003/018621 (Claim 1); WO2003/024392 (Claim 2; FIG. 93); WO2001/66689 (Example 6); LocusID:54894.

(11) STEAP2 (HGNC_8639, IPCA-1, PCANAP1, STAMP1, STEAP2, STMP, Prostate Cancer Associated Gene 1, Prostate Cancer Associated Protein 1, Six Transmembrane Epithelial Antigen of Prostate 2, Six Transmembrane Prostate Protein)
Nucleotide
Genbank accession no. AF455138
Genbank version no. AF455138.1 GI:22655487
Genbank record update date: Mar. 11, 2010 01:54 AM
Polypeptide
Genbank accession no. AAN04080
Genbank version no. AAN04080.1 GI:22655488
Genbank record update date: Mar. 11, 2010 01:54 AM
Cross References
*Lab. Invest.* 82 (11):1573-1582 (2002)); WO2003/087306; US2003/064397 (Claim 1; FIG. 1); WO2002/72596 (Claim 13; Page 54-55); WO2001/72962 (Claim 1; FIG. 4B); 35 WO2003/104270 (Claim 11); WO2003/104270 (Claim 16); US2004/005598 (Claim 22); WO2003/042661 (Claim 12); US2003/060612 (Claim 12; FIG. 10); WO2002/26822 (Claim 23; FIG. 2); WO2002/16429 (Claim 12; FIG. 10); GI:22655488.

(12) TrpM4 (BR22450, FLJ20041, TRPM4, TRPM4B, Transient Receptor Potential Cation 5 Channel, Subfamily M, Member 4)
Nucleotide
Genbank accession no. NM_017636
Genbank version no. NM_017636.3 GI:304766649
Genbank record update date: Jun. 29, 2012 11:27 AM
Polypeptide
Genbank accession no. NP_060106
Genbank version no. NP_060106.2 GI:21314671
Genbank record update date: Jun. 29, 2012 11:27 AM
Cross References
Xu, X. Z., et al *Proc. Natl. Acad. Sci. U.S.A.* 98 (19):10692-10697 (2001), *Cell* 109 (3):397-407 (2002), *J. Biol. Chem.* 278 (33):30813-30820 (2003)); US2003/143557 (Claim 4); WO2000/40614 (Claim 14; Page 100-103); WO2002/10382 (Claim 1; FIG. 9A); WO2003/042661 (Claim 12); WO2002/30268 (Claim 27; Page 391); US2003/219806 (Claim 4); WO2001/62794 (Claim 10 14; FIG. 1A-D); MIM:606936.

(13) CRIPTO (CR, CR1, CRGF, CRIPTO, TDGF1, Teratocarcinoma-Derived Growth Factor)
Nucleotide
Genbank accession no. NM_003212
Genbank version no. NM_003212.3 GI:292494881
Genbank record update date: Sep. 23, 2012 02:27 PM Polypeptide
Genbank accession no. NP_003203
Genbank version no. NP_003203.1 GI:4507425
Genbank record update date: Sep. 23, 2012 02:27 PM
Cross References
Ciccodicola, A., et al *EMBO J.* 8 (7):1987-1991 (1989), *Am. J. Hum. Genet.* 49 (3):555-565 (1991)); US2003/224411 (Claim 1); WO2003/083041 (Example 1); WO2003/034984 (Claim 12); WO2002/88170 (Claim 2; Page 52-53); WO2003/024392 (Claim 2; FIG. 58); WO2002/16413 (Claim 1; Page 94-95, 105); WO2002/22808 (Claim 2; FIG. 1); U.S. Pat. No. 5,854,399 (Example 2; Col 17-18); U.S. Pat. No. 5,792,616 (FIG. 2); MIM: 187395.

(14) CD21 (CR2 (Complement Receptor 2) or C3DR (C3d/Epstein Barr Virus Receptor) or Hs. 73792)
Nucleotide
Genbank accession no M26004
Genbank version no. M26004.1 GI:181939
Genbank record update date: Jun. 23, 2010 08:47 AM
Polypeptide
Genbank accession no. AAA35786
Genbank version no. AAA35786.1 GI:181940
Genbank record update date: Jun. 23, 2010 08:47 AM
Cross References
Fujisaku et al (1989) *J. Biol. Chem.* 264 (4):2118-2125); Weis J. J., et al *J. Exp. Med.* 167, 1047-1066, 1988; Moore M., et al *Proc. Natl. Acad. Sci. U.S.A.* 84, 9194-9198, 1987; Barel M., et al *Mol. Immunol.* 35, 1025-1031, 1998; Weis J. J., et al *Proc. Natl. Acad. Sci. U.S.A.* 83, 5639-5643, 1986; Sinha S. K., et al (1993) *J. Immunol.* 150, 5311-5320; WO2004/045520 (Example 4); US2004/005538 (Example 1); WO2003/062401 (Claim 9); WO2004/045520 (Example 4); WO91/02536 (FIGS. 9.1-9.9); WO2004/020595 (Claim 1); Accession: P20023; Q13866; Q14212; EMBL; M26004; AAA35786.1.

(15) CD79b (CD79B, CD79β, IGb (Immunoglobulin-Associated Beta), 829) Nucleotide
Genbank accession no NM_000626
Genbank version no. NM_000626.2 GI:90193589
Genbank record update date: Jun. 26, 2012 01:53 PM
Polypeptide
Genbank accession no. NP_000617
Genbank version no. NP_000617.1 GI:11038674
Genbank record update date: Jun. 26, 2012 01:53 PM
Cross References
*Proc. Natl. Acad. Sci. U.S.A.* (2003) 100 (7):4126-4131, *Blood* (2002) 100 (9):3068-3076, Muller et al (1992) *Eur. J. Immunol.* 22 (6):1621-1625); WO2004/016225 (claim 2, FIG. 140); WO2003/087768, US2004/101874 (claim 1, page 102); WO2003/062401 (claim 9); WO2002/78524 (Example 2); US2002/150573 (claim 35 5, page 15); U.S. Pat. No. 5,644,033; WO2003/048202 (claim 1, pages 306 and 309); WO 99/58658, U.S. Pat. No. 6,534,482 (claim 13, FIG. 17A/B); WO2000/55351 (claim 11, pages 1145-1146); MIM:147245

(16) FcRH2 (IFGP4, IRTA4, SPAP1A (SH2 Domain Containing Phosphatase Anchor Protein 51a), SPAP18, SPAP1C)
Nucleotide
Genbank accession no NM_030764
Genbank version no. NM_030764.3 GI:227430280
Genbank record update date: Jun. 30, 2012 12:30 AM
Polypeptide
Genbank accession no. NP_110391
Genbank version no. NP_110391.2 GI:19923629
Genbank record update date: Jun. 30, 2012 12:30 AM Cross References
AY358130); *Genome Res.* 13 (10):2265-2270 (2003), *Immunogenetics* 54 (2):87-95 (2002), *Blood* 99 (8):2662-2669 (2002), *Proc. Natl. Acad. Sci. U.S.A.* 98 (17):9772-9777 (2001), Xu, M. J., et al (2001) *Biochem. Biophys. Res. Commun.* 280 (3):768-775; WO2004/016225 (Claim 2); WO2003/077836; WO2001/38490 (Claim 5; FIG. 18D-1-18D-2); WO2003/097803 (Claim 12);
WO2003/089624 (Claim 25); MIM:606509.

(17) HER2 (ErbB2)
Nucleotide
Genbank accession no M11730
Genbank version no. M11730.1 GI:183986
Genbank record update date: Jun. 23, 2010 08:47 AM
Polypeptide
Genbank accession no. AAA75493
Genbank version no. AAA75493.1 GI:306840
Genbank record update date: Jun. 23, 2010 08:47 AM
Cross References
Coussens L., et al *Science* (1985) 230(4730):1132-1139); Yamamoto T., et al *Nature* 319, 230-234, 1986; Semba K., et al *Proc. Natl. Acad. Sci. U.S.A.* 82, 6497-6501, 1985; Swiercz J. M., et al *J. Cell Biol.* 165, 869-15 880, 2004; Kuhns J. J., et al *J. Biol. Chem.* 274, 36422-36427, 1999; Cho H.-S., et al *Nature* 421, 756-760, 2003; Ehsani A., et al (1993) *Genomics* 15, 426-429; WO2004/048938 (Example 2); WO2004/027049 (FIG. 11); WO2004/009622; WO2003/081210;
WO2003/089904 (Claim 9); WO2003/016475 (Claim 1); US2003/118592; WO2003/008537 (Claim 1); WO2003/055439 (Claim 29; FIG. 1A-B); WO2003/025228 (Claim 37; FIG. 5C); 20 WO2002/22636 (Example 13; Page 95-107); WO2002/12341 (Claim 68; FIG. 7); WO2002/13847 (Page 71-74); WO2002/14503 (Page 114-117); WO2001/53463 (Claim 2; Page 41-46); WO2001/41787 (Page 15); WO2000/44899 (Claim 52; FIG. 7); WO2000/20579 (Claim 3; FIG. 2); U.S. Pat. No. 5,869,445 (Claim 3; Col 31-38); WO9630514 (Claim 2; Page 56-61); EP1439393 (Claim 7); WO2004/043361 (Claim 7); WO2004/022709; WO2001/00244 25 (Example 3; FIG. 4); Accession: P04626; EMBL; M11767; AAA35808.1. EMBL; M11761; AAA35808.1

Antibodies
  Abbott: US20110177095
  For example, an antibody comprising CDRs having overall at least 80% sequence identity to CDRs having amino acid sequences of SEQ ID NO:3 (CDR-H1), SEQ ID NO:4 (CDR-H2), SEQ ID NO:5 (CDR-H3), SEQ ID NO:104 and/or SEQ ID NO:6 (CDR-L1), SEQ ID NO:7 (CDR-L2), and SEQ ID NO:8 (CDR-L3), wherein the anti-HER2 antibody or anti-HER2 binding fragment has reduced immunogenicity as compared to an antibody having a VH of SEQ ID NO:1 and a VL of SEQ ID NO:2.
  Biogen: US20100119511
  For example, ATCC accession numbers: PTA-10355, PTA-10356, PTA-10357, PTA-10358
  For example, a purified antibody molecule that binds to HER2 comprising a all six CDR's from an antibody selected from the group consisting of BIIB71F10 (SEQ ID NOs:11, 13), BIIB69A09 (SEQ ID NOs:15, 17); BIIB67F10 (SEQ ID NOs:19, 21); BIIB67F11 (SEQ ID NOs:23, 25), BIIB66A12 (SEQ ID NOs:27, 29), BIIB66C01 (SEQ ID NOs:31, 33), BIIB65C10 (SEQ ID NOs:35, 37), BIIB65H09 (SEQ ID NOs:39, 41) and BIIB65B03 (SEQ ID NOs:43, 45), or CDRs which are identical or which have no more than two alterations from said CDRs.

Herceptin (Genentech)—U.S. Pat. No. 6,054,297; ATCC accession no. CRL-10463 (Genentech)

Pertuzumab (Genentech)

US20110117097
for example, see SEQ IDs No. 15&16, SEQ IDs No. 17&18, SEQ IDs No. 23&24 & ATCC accession numbers HB-12215, HB-12216, CRL 10463, HB-12697.

US20090285837

US20090202546
for example, ATCC accession numbers: HB-12215, HB-12216, CRL 10463, HB-12698.

US20060088523
for example, ATCC accession numbers: HB-12215, HB-12216
for example, an antibody comprising the variable light and variable heavy amino acid sequences in SEQ ID Nos. 3 and 4, respectively.
for example, an antibody comprising a light chain amino acid sequence selected from SEQ ID No. 15 and 23, and a heavy chain amino acid sequence selected from SEQ ID No. 16 and 24

US20060018899
for example, ATCC accession numbers: (7C2) HB-12215, (7F3) HB-12216, (4D5) CRL-10463, (2C4) HB-12697.
for example, an antibody comprising the amino acid sequence in SEQ ID No. 23, or a deamidated and/or oxidized variant thereof.

US2011/0159014
for example, an antibody having a light chain variable domain comprising the hypervariable regions of SEQ ID NO: 1".
For example, an antibody having a heavy chain variable domain comprising the hypervariable regions of SEQ ID NO: 2.

US20090187007
Glycotope: TrasGEX antibody http://www.glycotope.com/pipeline
For example, see International Joint Cancer Institute and Changhai Hospital Cancer Cent: HMTI-Fc Ab—Gao J., et al *BMB Rep.* 2009 Oct. 31; 42(10):636-41.
Symphogen: US20110217305
Union Stem Cell & Gene Engineering, China—Liu H Q., et al *Xi Bao Yu Fen Zi Mian Yi Xue Za Zhi.* 2010 May; 26(5):456-8.

(18) NCA (CEACAM6)
Nucleotide
Genbank accession no M18728
Genbank version no. M18728.1 GI:189084
Genbank record update date: Jun. 23, 2010 08:48 AM
Polypeptide
Genbank accession no. AAA59907
Genbank version no. AAA59907.1 GI:189085
Genbank record update date: Jun. 23, 2010 08:48 AM
Cross References
Barnett T., et al *Genomics* 3, 59-66, 1988; Tawaragi Y., et al *Biochem. Biophys. Res. Commun.* 150, 89-96, 1988; Strausberg R. L., et al *Proc. Natl. Acad. Sci. U.S.A.* 99:16899-16903, 2002; WO2004/063709; EP1439393 (Claim 7); WO2004/044178 (Example 4); WO2004/031238; WO2003/042661 (Claim 12); WO2002/78524 (Example 2); WO2002/86443 (Claim 27; Page 427); WO2002/60317 (Claim 2); Accession: P40199; Q14920; EMBL; M29541; AAA59915.1.
EMBL; M18728.

(19) MDP (DPEP1)
Nucleotide
Genbank accession no BC017023
Genbank version no. BC017023.1 GI:16877538
Genbank record update date: Mar. 6, 2012 01:00 PM
Polypeptide
Genbank accession no. AAH17023
Genbank version no. AAH17023.1 GI:16877539
Genbank record update date: Mar. 6, 2012 01:00 PM
Cross References
*Proc. Natl. Acad. Sci. U.S.A.* 99 (26):16899-16903 (2002)); WO2003/016475 (Claim 1); WO2002/64798 (Claim 33; Page 85-87); JP05003790 (FIG. 6-8); WO99/46284 (FIG. 9); MIM:179780.

(20) IL20R-Alpha (IL20Ra, ZCYTOR7)
Nucleotide
Genbank accession no AF184971
Genbank version no. AF184971.1 GI:6013324
Genbank record update date: Mar. 10, 2010 10:00 PM
Polypeptide
Genbank accession no. AAF01320
Genbank version no. AAF01320.1 GI:6013325
Genbank record update date: Mar. 10, 2010 10:00 PM
Cross References
Clark H. F., et al *Genome Res.* 13, 2265-2270, 2003; Mungall A. J., et al *Nature* 425, 805-811, 2003; Blumberg H., et al *Cell* 104, 9-19, 2001; Dumoutier L., et al *J. Immunol.* 167, 3545-3549, 2001; Parrish-Novak J., et al *J. Biol. Chem.* 277, 47517-47523, 2002; Pletnev S., et al (2003) 10 *Biochemistry* 42:12617-12624; Sheikh F., et al (2004) *J. Immunol.* 172, 2006-2010; EP1394274 (Example 11); US2004/005320 (Example 5); WO2003/029262 (Page 74-75); WO2003/002717 (Claim 2; Page 63); WO2002/22153 (Page 45-47); US2002/042366 (Page 20-21); WO2001/46261 (Page 57-59); WO2001/46232 (Page 63-65); WO98/37193 (Claim 1; Page 55-59); Accession: Q9UHF4; Q6UWA9; Q96SH8; EMBL; AF184971; AAF01320.1.

(21) Brevican (BCAN, BEHAB)
Nucleotide
Genbank accession no AF229053
Genbank version no. AF229053.1 GI:10798902
Genbank record update date: Mar. 11, 2010 12:58 AM
Polypeptide
Genbank accession no. AAG23135
Genbank version no. AAG23135.1 GI:10798903
Genbank record update date: Mar. 11, 2010 12:58 AM
Cross References
Gary S. C., et al *Gene* 256, 139-147, 2000; Clark H. F., et al *Genome Res.* 13, 2265-2270, 2003; Strausberg R. L., et al *Proc. Natl. Acad. Sci. U.S.A.* 99, 16899-16903, 2002; US2003/186372 (Claim 11); US2003/186373 (Claim 11); US2003/119131 (Claim 1; FIG. 52); US2003/119122 (Claim 1; 20 FIG. 52); US2003/119126 (Claim 1); US2003/119121 (Claim 1; FIG. 52); US2003/119129 (Claim 1); US2003/119130 (Claim 1); US2003/119128 (Claim 1; FIG. 52); US2003/119125 (Claim 1); WO2003/016475 (Claim 1); WO2002/02634 (Claim 1)

(22) EphB2R (DRT, ERK, Hek5, EPHT3, Tyro5)
Nucleotide
Genbank accession no NM_004442
Genbank version no. NM_004442.6 GI:111118979
Genbank record update date: Sep. 8, 2012 04:43 PM Polypeptide
Genbank accession no. NP_004433
Genbank version no. NP_004433.2 GI:21396504
Genbank record update date: Sep. 8, 2012 04:43 PM
Cross References
Chan, J. and Watt, V. M., Oncogene 6 (6), 1057-1061 (1991) Oncogene 10 (5):897-905 (1995), Annu. Rev. Neurosci. 21:309-345 (1998), Int. Rev. Cytol. 196:177-244 (2000)); WO2003042661 (Claim 12); WO200053216 (Claim 1; Page 41); WO2004065576 (Claim 1); WO2004020583 (Claim 9); WO2003004529 (Page 128-132); WO200053216 (Claim 1; Page 42); MIM:600997.

(23) ASLG659 (B7h)
Nucleotide
Genbank accession no. AX092328
Genbank version no. AX092328.1 GI:13444478
Genbank record update date: Jan. 26, 2011 07:37 AM
Cross References
US2004/0101899 (Claim 2); WO2003104399 (Claim 11); WO2004000221 (FIG. 3); US2003/165504 (Claim 1); US2003/124140 (Example 2); US2003/065143 (FIG. 60); WO2002/102235 (Claim 13; Page 299); US2003/091580 (Example 2); WO2002/10187 (Claim 6; FIG. 10); WO2001/94641 (Claim 12; FIG. 7b); WO2002/02624 (Claim 13; FIG. 1A-1B); US2002/034749 (Claim 54; Page 45-46); WO2002/06317 (Example 2; Page 320-321, Claim 34; Page 321-322); WO2002/71928 (Page 468-469); WO2002/02587 (Example 1; FIG. 1); WO2001/40269 (Example 3; Pages 190-192); WO2000/36107 (Example 2; Page 205-207); WO2004/053079 (Claim 12); WO2003/004989 (Claim 1); WO2002/71928 (Page 233-234, 452-453); WO 01/16318.

(24) PSCA (Prostate Stem Cell Antigen Precursor)
Nucleotide
Genbank accession no AJ297436
Genbank version no. AJ297436.1 GI:9367211
Genbank record update date: Feb. 1, 2011 11:25 AM
Polypeptide
Genbank accession no. CAB97347
Genbank version no. CAB97347.1 GI:9367212
Genbank record update date: Feb. 1, 2011 11:25 AM
Cross References
Reiter R. E., et al *Proc. Natl. Acad. Sci. U.S.A.* 95, 1735-1740, 1998; Gu Z., et al *Oncogene* 19, 1288-1296, 2000; Biochem. Biophys. Res. Commun. (2000) 275(3):783-788; WO2004/022709; EP1394274 (Example 11); US2004/018553 (Claim 17); WO2003/008537 (Claim 1); WO2002/81646 (Claim 1; Page 164); WO2003/003906 (Claim 10; Page 288); WO2001/40309 (Example 1; FIG. 17); US2001/055751 (Example 1; FIG. 1b); WO2000/32752 (Claim 18; FIG. 1); WO98/51805 (Claim 17; Page 97); WO98/51824 (Claim 10; Page 94); WO98/40403 (Claim 2; FIG. 1B); Accession: 043653; EMBL; AF043498; AAC39607.1

(25) GEDA
Nucleotide
Genbank accession no AY260763
Genbank version no. AY260763.1 GI:30102448
Genbank record update date: Mar. 11, 2010 02:24 AM
Polypeptide
Genbank accession no. AAP14954
Genbank version no. AAP14954.1 GI:30102449
Genbank record update date: Mar. 11, 2010 02:24 AM
Cross References
AP14954 lipoma HMGIC fusion-partner like protein/pid=AAP14954.1—*Homo sapiens* (human); WO2003/054152 (Claim 20); WO2003/000842 (Claim 1); WO2003/023013 (Example 3, Claim 20); US2003/194704 (Claim 45); GI:30102449;

(26) BAFF-R (B Cell—Activating Factor Receptor, BLyS Receptor 3, BR3)
Nucleotide
Genbank accession no AF116456
Genbank version no. AF116456.1 GI:4585274
Genbank record update date: Mar. 10, 2010 09:44 PM
Polypeptide
Genbank accession no. AAD25356
Genbank version no. AAD25356.1 GI:4585275
Genbank record update date: Mar. 10, 2010 09:44 PM
Cross References
BAFF receptor/pid=NP_443177.1—*Homo sapiens*: Thompson, J. S., et al *Science* 293 (5537), 2108-2111 (2001); WO2004/058309; WO2004/011611; WO2003/045422 (Example; Page 32-33); WO2003/014294 (Claim 35; FIG. 6B); WO2003/035846 (Claim 70; Page 615-616); WO2002/94852 (Col 136-137); WO2002/38766 (Claim 3; Page 133); WO2002/24909 (Example 3; FIG. 3); MIM:606269; NP_443177.1; NM_052945_1; AF132600

(27) CD22 (B-Cell Receptor CD22-B Isoform, BL-CAM, Lyb-8, Lyb8, SIGLEC-2, FLJ22814)
Nucleotide
Genbank accession no AK026467
Genbank version no. AK026467.1 GI:10439337
Genbank record update date: Sep. 11, 2006 11:24 PM
Polypeptide
Genbank accession no. BAB15489
Genbank version no. BAB15489.1 GI:10439338
Genbank record update date: Sep. 11, 2006 11:24 PM
Cross References
Wilson et al (1991) *J. Exp. Med.* 173:137-146; WO2003/072036 (Claim 1; FIG. 1); IM:107266; NP_001762.1; NM_001771 1.

(27a) CD22 (CD22 molecule)
Nucleotide
Genbank accession no X52785
Genbank version no. X52785.1 GI:29778
Genbank record update date: Feb. 2, 2011 10:09 AM
Polypeptide
Genbank accession no. CAA36988
Genbank version no. CAA36988.1 GI:29779
Genbank record update date: Feb. 2, 2011 10:09 AM
Cross References
Stamenkovic I. et al., *Nature* 345 (6270), 74-77 (1990)??
Other Information
Official Symbol: CD22
Other Aliases: SIGLEC-2, SIGLEC2
Other Designations: B-cell receptor CD22; B-lymphocyte cell adhesion molecule; BL-CAM; CD22 antigen; T-cell surface antigen Leu-14; sialic acid binding Ig-like lectin 2; sialic acid-binding Ig-like lectin 2
Antibodies
G5/44 (Inotuzumab): DiJoseph J F., et al *Cancer Immunol Immunother.* 2005 January; 54(1):11-24.
Epratuzumab-Goldenberg D M., et al *Expert Rev Anticancer Ther.* 6(10): 1341-53, 2006.

(28) CD79a (CD79A, CD79alpha), Immunoglobulin-Associated Alpha, a B Cell-Specific Protein that Covalently Interacts with Ig Beta (CD79B) and Forms a Complex on the Surface with Ig M
35 Molecules, Transduces a Signal Involved in B-Cell Differentiation), pI: 4.84, MW: 25028 TM: 2 [P] Gene Chromosome: 19q13.2).

Nucleotide
Genbank accession no NM_001783
Genbank version no. NM_001783.3 GI:90193587
Genbank record update date: Jun. 26, 2012 01:48 PM
Polypeptide
Genbank accession no. NP_001774
Genbank version no. NP_001774.1 GI:4502685
Genbank record update date: Jun. 26, 2012 01:48 PM
Cross References
WO2003/088808, US2003/0228319; WO2003/062401 (claim 9); US2002/150573 (claim 4, pages 13-14); WO99/58658 (claim 13, FIG. 16); WO92/07574 (FIG. 1); U.S. Pat. No. 5,644,033; Ha et al (1992) *J. Immunol.* 148(5):1526-1531; Müller et al (1992) *Eur. J. Immunol.* 22:1621-1625; Hashimoto et al (1994) *Immunogenetics* 40(4):287-295; Preud'homme et al (1992) *Clin. Exp. Immunol.* 90(1):141-146; Yu et al (1992) *J. Immunol.* 148(2) 633-637; Sakaguchi et al (1988) *EMBO J.* 7(11): 3457-3464

(29) CXCR5 (Burkitt's Lymphoma Receptor 1, a G Protein-Coupled Receptor that is Activated by the CXCL13 Chemokine, Functions in Lymphocyte Migration and Humoral Defense, Plays a 10 Role in HIV-2 Infection and Perhaps Development of AIDS, Lymphoma, Myeloma, and Leukemia); 372 aa, pI: 8.54 MW: 41959 TM: 7 [P] Gene Chromosome: 11q23.3,
Nucleotide
Genbank accession no NM_001716
Genbank version no. NM_001716.4 GI:342307092
Genbank record update date: Sep. 30, 2012 01:49 PM
Polypeptide
Genbank accession no. NP_001707
Genbank version no. NP_001707.1 GI:4502415
Genbank record update date: Sep. 30, 2012 01:49 PM
Cross References
WO2004/040000; WO2004/015426; US2003/105292 (Example 2); U.S. Pat. No. 6,555,339 (Example 2); WO2002/61087 (FIG. 1); WO2001/57188 (Claim 20, page 269); WO2001/72830 (pages 12-13); WO2000/22129 (Example 1, pages 152-153, 15 Example 2, pages 254-256); WO99/28468 (claim 1, page 38); U.S. Pat. No. 5,440,021 (Example 2, col 49-52); WO94/28931 (pages 56-58); WO92/17497 (claim 7, FIG. 5); Dobner et al (1992) *Eur. J. Immunol.* 22:2795-2799; Barella et al (1995) *Biochem. J.* 309:773-779

(30) HLA-DOB (Beta Subunit of MHC Class II Molecule (La Antigen) that Binds Peptides and 20 Presents them to CD4+T Lymphocytes); 273 aa, pI: 6.56, MW: 30820.TM: 1 [P] Gene Chromosome: 6p21.3)
Nucleotide
Genbank accession no NM_002120
Genbank version no. NM_002120.3 GI:118402587
Genbank record update date: Sep. 8, 2012 04:46 PM
Polypeptide
Genbank accession no. NP_002111
Genbank version no. NP_002111.1 GI:4504403
Genbank record update date: Sep. 8, 2012 04:46 PM
Cross References
Tonnelle et al (1985) *EMBO J.* 4(11):2839-2847; Jonsson et al (1989) *Immunogenetics* 29(6):411-413; Beck et al (1992) *J. Mol. Biol.* 228:433-441; Strausberg et al (2002) *Proc. Natl. Acad. Sci USA* 99:16899-16903; Servenius et al (1987) *J. Biol. Chem.* 262:8759-8766; Beck et al (1996) *J. Mol. Biol.* 25 255:1-13; Naruse et al (2002) *Tissue Antigens* 59:512-519; WO99/58658 (claim 13, FIG. 15); U.S. Pat. No. 6,153,408 (Col 35-38); U.S. Pat. No. 5,976,551 (col 168-170); U.S. Pat. No. 6,011,146 (col 145-146); Kasahara et al (1989) *Immunogenetics* 30(1): 66-68; Larhammar et al (1985) *J. Biol. Chem.* 260(26): 14111-14119

(31) P2X5 (Purinergic Receptor P2X Ligand-Gated Ion Channel 5, an Ion Channel Gated by Extracellular ATP, May be Involved in Synaptic Transmission and Neurogenesis, Deficiency May Contribute to the Pathophysiology of Idiopathic Detrusor Instability); 422 aa), pI: 7.63, MW: 47206 TM: 1 [P] Gene Chromosome: 17p13.3).
Nucleotide
Genbank accession no NM_002561
Genbank version no. NM_002561.3 GI:325197202
Genbank record update date: Jun. 27, 2012 12:41 AM
Polypeptide
Genbank accession no. NP_002552
Genbank version no. NP_002552.2 GI:28416933
Genbank record update date: Jun. 27, 2012 12:41 AM
Cross References
Le et al (1997) *FEBS Lett.* 418(1-2):195-199; WO2004/047749; WO2003/072035 (claim 10); Touchman et al (2000) *Genome Res.* 10:165-173; WO2002/22660 (claim 20); WO2003/093444 (claim 1); WO2003/087768 (claim 1); WO2003/029277 (page 82)

(32) CD72 (B-Cell Differentiation Antigen CD72, Lyb-2); 359 aa, pI: 8.66, MW: 40225, TM: 1 5 [P] Gene Chromosome: 9p13.3).
Nucleotide
Genbank accession no NM_001782
Genbank version no. NM_001782.2 GI:194018444
Genbank record update date: Jun. 26, 2012 01:43 PM
Polypeptide
Genbank accession no. NP_001773
Genbank version no. NP_001773.1 GI:4502683
Genbank record update date: Jun. 26, 2012 01:43 PM
Cross References
WO2004042346 (claim 65); WO2003/026493 (pages 51-52, 57-58); WO2000/75655 (pages 105-106); Von Hoegen et al (1990) *J. Immunol.* 144(12):4870-4877; Strausberg et al (2002) *Proc. Natl. Acad. Sci USA* 99:16899-16903.

(33) LY64 (Lymphocyte Antigen 64 (RP105), Type I Membrane Protein of the Leucine Rich Repeat (LRR) Family, Regulates B-Cell Activation and Apoptosis, Loss of Function is Associated with Increased Disease Activity in Patients with Systemic Lupus Erythematosis); 661 aa, pI: 6.20, MW: 74147 TM: 1 [P] Gene Chromosome: 5q12).
Nucleotide
Genbank accession no NM_005582
Genbank version no. NM_005582.2 GI:167555126
Genbank record update date: Sep. 2, 2012 01:50 PM
Polypeptide
Genbank accession no. NP_005573
Genbank version no. NP_005573.2 GI:167555127
Genbank record update date: Sep. 2, 2012 01:50 PM
Cross References
US2002/193567; WO97/07198 (claim 11, pages 39-42); Miura et al (1996) 15 *Genomics* 38(3):299-304; Miura et al (1998) *Blood* 92:2815-2822; WO2003/083047; WO97/44452 (claim 8, pages 57-61); WO2000/12130 (pages 24-26).

(34) FcRH1 (Fc Receptor-Like Protein 1, a Putative Receptor for the Immunoglobulin Fc Domain that Contains C2 Type Ig-Like and ITAM Domains, May have a Role in B-Lymphocyte 20 Differentiation); 429 aa, pI: 5.28, MW: 46925 TM: 1 [P] Gene Chromosome: 1q21-1q22)

Nucleotide
Genbank accession no NM_052938
Genbank version no. NM_052938.4 GI:226958543
Genbank record update date: Sep. 2, 2012 01:43 PM
Polypeptide
Genbank accession no. NP_443170
Genbank version no. NP_443170.1 GI:16418419
Genbank record update date: Sep. 2, 2012 01:43 PM
Cross References
WO2003/077836; WO2001/38490 (claim 6, FIG. 18E-1-18-E-2); Davis et al (2001) *Proc. Natl. Acad. Sci USA* 98(17):9772-9777; WO2003/089624 (claim 8); EP1347046 (claim 1); WO2003/089624 (claim 7).

(35) IRTA2 (Immunoglobulin Superfamily Receptor Translocation Associated 2, a Putative Immunoreceptor with Possible Roles in B Cell Development and Lymphoma Genesis; Deregulation of the Gene by Translocation Occurs in Some B Cell Malignancies); 977 aa, pI: 6.88, MW: 106468, TM: 1 [P] Gene Chromosome: 1q21)
Nucleotide
Genbank accession no AF343662
Genbank version no. AF343662.1 GI:13591709
Genbank record update date: Mar. 11, 2010 01:16 AM
Polypeptide
Genbank accession no. AAK31325
Genbank version no. AAK31325.1 GI:13591710
Genbank record update date: Mar. 11, 2010 01:16 AM
Cross References
AF343663, AF343664, AF343665, AF369794, AF397453, AK090423, AK090475, AL834187, AY358085; Mouse: AK089756, AY158090, AY506558; NP_112571.1; WO2003/024392 (claim 2, FIG. 97); Nakayama et al (2000) *Biochem. Biophys. Res. Commun.* 277(1):124-127; WO2003/077836; WO2001/38490 (claim 3, FIG. 18B-1-18B-2).

(36) TENB2 (TMEFF2, Tomoregulin, TPEF, HPP1, TR, Putative Transmembrane 35 Proteoglycan, Related to the EGF/Heregulin Family of Growth Factors and Follistatin); 374 aa)
Nucleotide
Genbank accession no AF179274
Genbank version no. AF179274.2 GI:12280939
Genbank record update date: Mar. 11, 2010 01:05 AM
Polypeptide
Genbank accession no. AAD55776
Genbank version no. AAD55776.2 GI:12280940
Genbank record update date: Mar. 11, 2010 01:05 AM
Cross References
NCBI Accession: AAD55776, AAF91397, AAG49451, NCBI RefSeq: NP_057276; NCBI Gene: 23671; OMIM: 605734; SwissProt Q9UIK5; AY358907, CAF85723, CQ782436; WO2004/074320; JP2004113151; WO2003/042661; WO2003/009814; EP1295944 (pages 69-70); WO2002/30268 (page 329); WO2001/90304; US2004/249130; US2004/022727; WO2004/063355; US2004/197325; US2003/232350; 5 US2004/005563; US2003/124579; Hone et al (2000) *Genomics* 67:146-152; Uchida et al (1999) *Biochem. Biophys. Res. Commun.* 266:593-602; Liang et al (2000) *Cancer Res.* 60:4907-12; Glynne-Jones et al (2001) *Int J Cancer.* October 15; 94(2):178-84.

(37) PSMA-FOLH1 (Folate Hydrolase (Prostate-Specific Membrane Antigen) 1)
Nucleotide
Genbank accession no M99487
Genbank version no. M99487.1 GI:190663
Genbank record update date: Jun. 23, 2010 08:48 AM
Polypeptide
Genbank accession no. AAA60209
Genbank version no. AAA60209.1 GI:190664
Genbank record update date: Jun. 23, 2010 08:48 AM
Cross References
Israeli R. S., et al *Cancer Res.* 53 (2), 227-230 (1993)
Other Information
Official Symbol: FOLH1
Other Aliases: GIG27, FGCP, FOLH, GCP2, GCPII, NAALAD1, NAALAdase, PSM, PSMA, mGCP
Other Designations: N-acetylated alpha-linked acidic dipeptidase 1; N-acetylated-alpha-linked acidic dipeptidase I; NAALADase I; cell growth-inhibiting gene 27 protein; folylpoly-gamma-glutamate carboxypeptidase; glutamate carboxylase II; glutamate carboxypeptidase 2; glutamate carboxypeptidase II; membrane glutamate carboxypeptidase; prostate specific membrane antigen variant F; pteroyl-poly-gamma-glutamate carboxypeptidase
Antibodies
U.S. Pat. No. 7,666,425:
Antibodies produces by Hybridomas having the following ATCC references:ATCC accession No. HB-12101, ATCC accession No. HB-12109, ATCC accession No. HB-12127 and ATCC accession No. HB-12126.
Proscan: a monoclonal antibody selected from the group consisting of 8H12, 3E11, 17G1, 29B4, 30C1 and 20F2 (U.S. Pat. No. 7,811,564; Moffett S., et al *Hybridoma (Larchmt).* 2007 December; 26(6):363-72).
Cytogen: monoclonal antibodies 7E11-05 (ATCC accession No. HB 10494) and 9H10-A4 (ATCC accession No. HB11430)—U.S. Pat. No. 5,763,202
GlycoMimetics: NUH2—ATCC accession No. HB 9762 (U.S. Pat. No. 7,135,301)
Human Genome Science: HPRAJ70—ATCC accession No. 97131 (U.S. Pat. No. 6,824,993); Amino acid sequence encoded by the cDNA clone (HPRAJ70) deposited as American Type Culture Collection ("ATCC") Deposit No. 97131
Medarex: Anti-PSMA antibodies that lack fucosyl residues—U.S. Pat. No. 7,875,278
Mouse anti-PSMA antibodies include the 3F5.4G6, 3D7.1.1, 4E10-1.14, 3E11, 4D8, 3E6, 3C9, 2C7, 1G3, 3C4, 3C6, 4D4, 1G9, 5C8B9, 3G6, 4C8B9, and monoclonal antibodies. Hybridomas secreting 3F5.4G6, 3D7.1.1, 4E10-1.14, 3E11, 4D8, 3E6, 3C9, 2C7, 1G3, 3C4, 3C6, 4D4, 1 G9, 5C8B9, 3G6 or 4C8B9 have been publicly deposited and are described in U.S. Pat. No. 6,159,508. Relevant hybridomas have been publicly deposited and are described in U.S. Pat. No. 6,107,090. Moreover, humanized anti-PSMA antibodies, including a humanized version of J591, are described in further detail in PCT Publication WO 02/098897.

Other mouse anti-human PSMA antibodies have been described in the art, such as mAb 107-1A4 (Wang, S. et al. (2001) *Int. J. Cancer* 92:871-876) and mAb 2C9 (Kato, K. et al. (2003) *Int. J. Urol.* 10:439-444).

Examples of human anti-PSMA monoclonal antibodies include the 4A3, 7F12, 8C12, 8A11, 16F9, 2A10, 2C6, 2F5 and 1C3 antibodies, isolated and structurally characterized as originally described in PCT Publications WO 01/09192 and WO 03/064606 and in U.S. Provisional Application Ser. No. 60/654,125, entitled "Human Monoclonal Antibodies to Prostate Specific Membrane Antigen (PSMA)", filed on Feb. 18, 2005. The V.sub.H amino acid sequences of 4A3, 7F12, 8C12, 8A11, 16F9, 2A10, 2C6, 2F5 and 1C3 are shown in SEQ ID NOs: 1-9, respectively. The V.sub.L amino acid sequences of 4A3, 7F12, 8C12, 8A11, 16F9, 2A10, 2C6, 2F5 and 1C3 are shown in SEQ ID NOs: 10-18, respectively.

Other human anti-PSMA antibodies include the antibodies disclosed in PCT Publication WO 03/034903 and US Application No. 2004/0033229.

NW Biotherapeutics: A hybridoma cell line selected from the group consisting of 3F5.4G6 having ATCC accession number HB12060, 3D7-1.I. having ATCC accession number HB12309, 4E10-1.14 having ATCC accession number HB12310, 3E11 (ATCC HB12488), 4D8 (ATCC HB12487), 3E6 (ATCC HB12486), 3C9 (ATCC HB12484), 2C7 (ATCC HB12490), 1G3 (ATCC HB12489), 3C4 (ATCC HB12494), 3C6 (ATCC HB12491), 4D4 (ATCC HB12493), 1G9 (ATCC HB12495), 5C8B9 (ATCC HB12492) and 3G6 (ATCC HB12485)—see U.S. Pat. No. 6,150,508

PSMA Development Company/Progenics/Cytogen—Seattle Genetics: mAb 3.9, produced by the hybridoma deposited under ATCC Accession No. PTA-3258 or mAb 10.3, produced by the hybridoma deposited under ATCC Accession No. PTA-3347—U.S. Pat. No. 7,850,971

PSMA Development Company—Compositions of PSMA antibodies (US 20080286284, Table 1)
  This application is a divisional of U.S. patent application Ser. No. 10/395,894, filed on Mar. 21, 2003 (U.S. Pat. No. 7,850,971)
  University Hospital Freiburg, Germany—mAbs 3/A12, 3/E7, and 3/F11 (Wolf P., et al *Prostate.* 2010 Apr. 1; 70(5):562-9).

(38) SST (Somatostatin Receptor; Note that there are 5 Subtypes)
(38.1) SSTR2 (Somatostatin Receptor 2)
Nucleotide
Genbank accession no NM_001050
Genbank version no. NM_001050.2 GI:44890054
Genbank record update date: Aug. 19, 2012 01:37 PM
Polypeptide
Genbank accession no. NP_001041
Genbank version no. NP_001041.1 GI:4557859
Genbank record update date: Aug. 19, 2012 01:37 PM
Cross References
Yamada Y., et al Proc. Natl. Acad. Sci. U.S.A. 89 (1), 251-255 (1992); Susini C., et al Ann Oncol. 2006 December; 17(12):1733-42
Other Information
  Official Symbol: SSTR2
  Other Designations: SRIF-1; 552R; somatostatin receptor type 2
(38.2) SSTR5 (Somatostatin Receptor 5)
Nucleotide
Genbank accession no D16827
Genbank version no. D16827.1 GI:487683
Genbank record update date: Aug. 1, 2006 12:45 PM
Polypeptide
Genbank accession no. BAA04107
Genbank version no. BAA04107.1 GI:487684
Genbank record update date: Aug. 1, 2006 12:45 PM
Cross References
Yamada, Y., et al *Biochem. Biophys. Res. Commun.* 195 (2), 844-852 (1993)
Other Information
  Official Symbol: SSTR5
  Other Aliases: SS-5-R
  Other Designations: Somatostatin receptor subtype 5; somatostatin receptor type 5

(38.3) SSTR1
(38.4) SSTR3
(38.5) SSTR4
AvB6—Both Subunits (39+40)
(39) ITGAV (Integrin, alpha V;
Nucleotide
Genbank accession no M14648 J02826 M18365
Genbank version no. M14648.1 GI:340306
Genbank record update date: Jun. 23, 2010 08:56 AM
Polypeptide
Genbank accession no. AAA36808
Genbank version no. AAA36808.1 GI:340307
Genbank record update date: Jun. 23, 2010 08:56 AM
Cross References
Suzuki S., et al *Proc. Natl. Acad. Sci. U.S.A.* 83 (22), 8614-8618 (1986)
Other Information
  Official Symbol: ITGAV
  Other Aliases: CD51, MSK8, VNRA, VTNR
  Other Designations: antigen identified by monoclonal antibody L230; integrin alpha-V; integrin alphaVbeta3; integrin, alpha V (vitronectin receptor, alpha polypeptide, antigen CD51); vitronectin receptor subunit alpha
(40) ITGB6 (Integrin, Beta 6)
Nucleotide
Genbank accession no NM_000888
Genbank version no. NM_000888.3 GI:9966771
Genbank record update date: Jun. 27, 2012 12:46 AM
Polypeptide
Genbank accession no. NP_000879
Genbank version no. NP_000879.2 GI:9625002
Genbank record update date: Jun. 27, 2012 12:46 AM
Cross References
Sheppard D. J., et al *Biol. Chem.* 265 (20), 11502-11507 (1990)
Other Information
  Official Symbol: ITGB6
  Other Designations: integrin beta-6
Antibodies
  Biogen: U.S. Pat. No. 7,943,742—Hybridoma clones 6.3G9 and 6.8G6 were deposited with the ATCC, accession numbers ATCC PTA-3649 and -3645, respectively.
  Biogen: U.S. Pat. No. 7,465,449—In some embodiments, the antibody comprises the same heavy and light chain polypeptide sequences as an antibody produced by hybridoma 6.1A8, 6.3G9, 6.8G6, 6.2B1, 6.2B10, 6.2A1, 6.2E5, 7.1G10, 7.7G5, or 7.105.
  Centocor (J&J): U.S. Pat. No. 7,550,142; U.S. Pat. No. 7,163,681
    For example in U.S. Pat. No. 7,550,142—an antibody having human heavy chain and human light chain variable regions comprising the amino acid sequences shown in SEQ ID NO: 7 and SEQ ID NO: 8.
  Seattle Genetics: 15H3 (Ryan M C., et al Cancer Res Apr. 15, 2012; 72(8 Supplement): 4630)
(41) CEACAM5 (Carcinoembryonic Antigen-Related Cell Adhesion Molecule 5)
Nucleotide
Genbank accession no M17303
Genbank version no. M17303.1 GI:178676
Genbank record update date: Jun. 23, 2010 08:47 AM
Polypeptide
Genbank accession no. AAB59513
Genbank version no. AAB59513.1 GI:178677
Genbank record update date: Jun. 23, 2010 08:47 AM Cross References
Beauchemin N., et al *Mol. Cell. Biol.* 7 (9), 3221-3230 (1987)
Other Information
   Official Symbol: CEACAM5
   Other Aliases: CD66e, CEA
   Other Designations: meconium antigen 100
Antibodies
   AstraZeneca-MedImmune:US 20100330103; US20080057063;
      US20020142359
         for example an antibody having complementarity determining regions (CDRs) with the following sequences: heavy chain; CDR1—DNYMH, CDR2—WIDPENGDTE YAPKFRG, CDR3—LIYAGYLAMD Y; and light chain CDR1—SASSSVTYMH, CDR2—STSNLAS, CDR3—QQRSTYPLT.
         Hybridoma 806.077 deposited as European Collection of Cell Cultures (ECACC) deposit no. 96022936.
   Research Corporation Technologies, Inc.:U.S. Pat. No. 5,047,507
   Bayer Corporation: U.S. Pat. No. 6,013,772
   BioAlliance: U.S. Pat. No. 7,982,017; U.S. Pat. No. 7,674,605
      U.S. Pat. No. 7,674,605
         an antibody comprising the heavy chain variable region sequence from the amino acid sequence of SEQ ID NO: 1, and the light chain variable region sequence from the amino acid sequence of SEQ ID NO:2.
         an antibody comprising the heavy chain variable region sequence from the amino acid sequence of SEQ ID NO:5, and the light chain variable region sequence from the amino acid sequence of SEQ ID NO:6.
   Celltech Therapeutics Limited: U.S. Pat. No. 5,877,293
   The Dow Chemical Company: U.S. Pat. No. 5,472,693; U.S. Pat. No. 6,417,337; U.S. Pat. No. 6,333,405
      U.S. Pat. No. 5,472,693—for example, ATCC No. CRL-11215
      U.S. Pat. No. 6,417,337—for example, ATCC CRL-12208
      U.S. Pat. No. 6,333,405—for example, ATCC CRL-12208
   Immunomedics, Inc: U.S. Pat. No. 7,534,431; U.S. Pat. No. 7,230,084; U.S. Pat. No. 7,300,644; U.S. Pat. No. 6,730,300;
      US20110189085
         an antibody having CDRs of the light chain variable region comprise: CDR1 comprises KASQDVGTSVA (SEQ ID NO: 20); CDR2 comprises WTSTRHT (SEQ ID NO: 21); and CDR3 comprises QQYSLYRS (SEQ ID NO: 22);
         and the CDRs of the heavy chain variable region of said anti-CEA antibody comprise: CDR1 comprises TYWMS (SEQ ID NO: 23); CDR2 comprises EIHPDSSTINYAPSLKD (SEQ ID NO: 24); and CDR3 comprises LYFGFPWFAY (SEQ ID NO: 25).
   US20100221175; US20090092598; US20070202044; US20110064653; US20090185974; US20080069775.
(42) MET (Met Proto-Oncogene; Hepatocyte Growth Factor Receptor)
Nucleotide
Genbank accession no M35073
Genbank version no. M35073.1 GI:187553
Genbank record update date: Mar. 6, 2012 11:12 AM
Polypeptide
Genbank accession no. AAA59589
Genbank version no. AAA59589.1 GI:553531
Genbank record update date: Mar. 6, 2012 11:12 AM
Cross References
Dean M., et al *Nature* 318 (6044), 385-388 (1985)
Other Information
   Official Symbol: MET
   Other Aliases: AUTS9, HGFR, RCCP2, c-Met
   Other Designations: HGF receptor; HGF/SF receptor; SF receptor; hepatocyte growth factor receptor; met proto-oncogene tyrosine kinase; proto-oncogene c-Met; scatter factor receptor; tyrosine-protein kinase Met
Antibodies
   Abgenix/Pfizer: US20100040629
      for example, the antibody produced by hybridoma 13.3.2 having American Type Culture Collection (ATCC) accession number PTA-5026; the antibody produced by hybridoma 9.1.2 having ATCC accession number PTA-5027; the antibody produced by hybridoma 8.70.2 having ATCC accession number PTA-5028; or the antibody produced by hybridoma 6.90.3 having ATCC accession number PTA-5029.
   Amgen/Pfizer: US20050054019
      for example, an antibody comprising a heavy chain having the amino acid sequences set forth in SEQ ID NO: 2 where X2 is glutamate and X4 is serine and a light chain having the amino acid sequence set forth in SEQ ID NO: 4 where X8 is alanine, without the signal sequences; an antibody comprising a heavy chain having the amino acid sequences set forth in SEQ ID NO: 6 and a light chain having the amino acid sequence set forth in SEQ ID NO: 8, without the signal sequences; an antibody comprising a heavy chain having the amino acid sequences set forth in SEQ ID NO: 10 and a light chain having the amino acid sequence set forth in SEQ ID NO: 12, without the signal sequences; or an antibody comprising a heavy chain having the amino acid sequences set forth in SEQ ID NO: 14 and a light chain having the amino acid sequence set forth in SEQ ID NO: 16, without the signal sequences.
   Agouron Pharmaceuticals (Now Pfizer): US20060035907
   Eli Lilly: US20100129369
   Genentech: U.S. Pat. No. 5,686,292; US20100028337; US20100016241; US20070129301; US20070098707; US20070092520, US20060270594; US20060134104; US20060035278; US20050233960; US20050037431
      U.S. Pat. No. 5,686,292—for example, ATCC HB-11894 and ATCC HB-11895
      US 20100016241—for example, ATCC HB-11894 (hybridoma 1A3.3.13) or HB-11895 (hybridoma 5D5.11.6)
   National Defense Medical Center, Taiwan: Lu R M., et al Biomaterials. 2011 April; 32(12):3265-74.
   Novartis: US20090175860
      for example, an antibody comprising the sequences of CDR1, CDR2 and
      CDR3 of heavy chain 4687, wherein the sequences of CDR1, CDR2, and CDR3 of heavy chain 4687 are residues 26-35, 50-65, and 98-102, respectively, of SEQ ID NO: 58; and the sequences of CDR1, CDR2, and CDR3 of light chain 5097, wherein the sequences of CDR1, CDR2, and CDR3 of light chain 5097 are residues 24-39, 55-61, and 94-100 of SEQ ID NO: 37.
   Pharmacia Corporation: US20040166544
   Pierre Fabre: US20110239316, US20110097262, US20100115639

Sumsung: US 20110129481—for example a monoclonal antibody produced from a hybridoma cell having accession number KCLRF-BP-00219 or accession number of KCLRF-BP-00223.

Samsung: US 20110104176—for example an antibody produced by a hybridoma cell having Accession Number: KCLRF-BP-00220.

University of Turin Medical School: DN-30 Pacchiana G., et al *J Biol Chem.* 2010 Nov. 12; 285(46):36149-57

Van Andel Research Institute: Jiao Y., et al *Mol Biotechnol.* 2005 September; 31(1):41-54.

(43) MUC1 (Mucin 1, Cell Surface Associated)
Nucleotide
Genbank accession no J05581
Genbank version no. J05581.1 GI:188869
Genbank record update date: Jun. 23, 2010 08:48 AM
Polypeptide
Genbank accession no. AAA59876
Genbank version no. AAA59876.1 GI:188870
Genbank record update date: Jun. 23, 2010 08:48 AM
Cross References
Gendler S. J., et al *J. Biol. Chem.* 265 (25), 15286-15293 (1990)
Other Information
  Official Symbol: MUC1
  Other Aliases: RP11-263K19.2, CD227, EMA, H23AG, KL-6, MAM6, MUC-1, MUC-1/SEC, MUC-1/X, MUC1/ZD, PEM, PEMT, PUM
  Other Designations: DF3 antigen; H23 antigen; breast carcinoma-associated antigen DF3; carcinoma-associated mucin; episialin; krebs von den Lungen-6; mucin 1, transmembrane; mucin-1; peanut-reactive urinary mucin; polymorphic epithelial mucin; tumor associated epithelial mucin; tumor-associated epithelial membrane antigen; tumor-associated mucin
Antibodies
  AltaRex-Quest Pharma Tech: U.S. Pat. No. 6,716,966—for example an Alt-1 antibody produced by the hybridoma ATCC No PTA-975.
  AltaRex-Quest Pharma Tech: U.S. Pat. No. 7,147,850
  CRT: 5E5—Sørensen A L., et al *Glycobiology* vol. 16 no. 2 pp. 96-107, 2006; HMFG2—Burchell J., et al *Cancer Res.,* 47, 5476-5482 (1987)
  Glycotope GT-MAB: GT-MAB 2.5-GEX (Website: http://www.glycotope.com/pipeline/pankomab-gex)
  Immunogen: U.S. Pat. No. 7,202,346
    for example, antibody MJ-170: hybridoma cell line MJ-170 ATCC accession no. PTA-5286Monoclonal antibody MJ-171: hybridoma cell line MJ-171 ATCC accession no. PTA-5287; monoclonal antibody MJ-172: hybridoma cell line MJ-172 ATCC accession no. PTA-5288; or monoclonal antibody MJ-173: hybridoma cell line MJ-173 ATCC accession no. PTA-5302
  Immunomedics: U.S. Pat. No. 6,653,104
  Ramot Tel Aviv Uni: U.S. Pat. No. 7,897,351
  Regents Uni. CA: U.S. Pat. No. 7,183,388; US20040005647; US20030077676.
  Roche GlycArt: U.S. Pat. No. 8,021,856
  Russian National Cancer Research Center: Imuteran-Ivanov P K., et al *Biotechnol J.* 2007 July; 2(7):863-70
  Technische Univ Braunschweig: (IIB6, HT186-B7, HT186-D11, HT186-G2, HT200-3A-C1, HT220-M-D1, HT220-M-G8)—Thie H., et al *PLoS One.* 2011 Jan. 14; 6(1):e15921

(44) CA9 (Carbonic Anhydrase IX)
Nucleotide
Genbank accession no. X66839
Genbank version no. X66839.1 GI:1000701
Genbank record update date: Feb. 2, 2011 10:15 AM
Polypeptide
Genbank accession no. CAA47315
Genbank version no. CAA47315.1 GI:1000702
Genbank record update date: Feb. 2, 2011 10:15 AM
Cross References
Pastorek J., et al *Oncogene* 9 (10), 2877-2888 (1994)
Other Information
  Official Symbol: CA9
  Other Aliases: CAIX, MN
  Other Designations: CA-IX; P54/58N; RCC-associated antigen G250; RCC-associated protein G250; carbonate dehydratase IX; carbonic anhydrase 9; carbonic dehydratase; membrane antigen MN; pMW1; renal cell carcinoma-associated antigen G250
Antibodies
  Abgenix/Amgen: US20040018198
  Affibody: Anti-CAIX Affibody molecules (http://www.affibody.com/en/Product-Portfolio/Pipeline/)
  Bayer: U.S. Pat. No. 7,462,696
  Bayer/Morphosys: 3ee9 mAb—Petrul H M., et al *Mol Cancer Ther.* 2012 February; 11(2):340-9
  Harvard Medical School: Antibodies G10, G36, G37, G39, G45, G57, G106, G119, G6, G27, G40 and G125. Xu C., et al *PLoS One.* 2010 Mar. 10; 5(3):e9625
  Institute of Virology, Slovak Academy of Sciences (Bayer)—U.S. Pat. No. 5,955,075
    for example, M75-ATCC Accession No. HB 11128 or MN12—ATCC Accession No. HB 11647
  Institute of Virology, Slovak Academy of Sciences: U.S. Pat. No. 7,816,493
    for example the M75 monoclonal antibody that is secreted from the hybridoma VU-M75, which was deposited at the American Type Culture Collection under ATCC No. HB 11128; or the V/10 monoclonal antibody secreted from the hybridoma V/10-VU, which was deposited at the International Depository Authority of the Belgian Coordinated Collection of Microorganisms (BCCM) at the Laboratorium voor Moleculaire Bioloqie-Plasmid-encollectie (LMBP) at the Universeit Gent in Gent, Belgium, under Accession No. LMBP 6009CB.
  Institute of Virology, Slovak Academy of Sciences US20080177046; US20080176310; US20080176258; US20050031623
  Novartis: US20090252738
  Wilex: U.S. Pat. No. 7,691,375—for example the antibody produced by the hybridoma cell line DSM ASC 2526.
  Wilex: US20110123537; Rencarex: Kennett R H., et al *Curr Opin Mol Ther.* 2003 February; 5(1):70-5
  Xencor: US20090162382

(45) EGFRvIII (Epidermal Growth Factor Receptor (EGFR), Transcript Variant 3,
Nucleotide
Genbank accession no. NM_201283
Genbank version no. NM_201283.1 GI:41327733
Genbank record update date: Sep. 30, 2012 01:47 PM
Polypeptide
Genbank accession no. NP_958440
Genbank version no. NP_958440.1 GI:41327734
Genbank record update date: Sep. 30, 2012 01:47 PM
Cross-References
Batra S K., et al *Cell Growth Differ* 1995; 6:1251-1259.

Antibodies:
U.S. Pat. No. 7,628,986 and U.S. Pat. No. 7,736,644 (Amgen)
  For example, a heavy chain variable region amino acid sequence selected from the group consisting of SEQ ID NO: 142 and variants & a light chain variable region amino acid sequence selected from the group consisting of: SEQ ID NO: 144 and variants.
US20100111979 (Amgen)
  For example, an antibody comprising a heavy chain amino acid sequence comprising:
  CDR1 consisting of a sequence selected from the group consisting of the amino acid sequences for the CDR1 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17);
  CDR2 consisting of a sequence selected from the group consisting of the amino acid sequences for the CDR2 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17); and
  CDR3 consisting of a sequence selected from the group consisting of the amino acid sequences for the CDR3 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
US20090240038 (Amgen)
  For example, an antibody having at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.
US20090175887 (Amgen)
  For example, an antibody having a heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
US20090156790 (Amgen)
  For example, antibody having heavy chain polypeptide and a light chain polypeptide, wherein at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.
US20090155282, US20050059087 and US20050053608 (Amgen)
  For example, an antibody heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).
MR1-1 (U.S. Pat. No. 7,129,332; Duke)
  For example, a variant antibody having the sequence of SEQ ID NO.18 with the substitutions S98P-T99Y in the CDR3 VH, and F92W in CDR3 VL.
L8A4, H10, Y10 (Wikstrand C J., et al *Cancer Res.* 1995 Jul. 15; 55(14):3140-8; Duke)
US20090311803 (Harvard University)
  For example, SEQ ID NO:9 for antibody heavy chain variable region, and SEQ ID NO: 3 for light chain variable region amino acid sequences
US20070274991 (EMD72000, also known as matuzumab; Harvard University)
  For example, SEQ ID NOs: 3 & 9 for light chain and heavy chain respectively
U.S. Pat. No. 6,129,915 (Schering)
  For example, SEQ. ID NOs: 1, 2, 3, 4, 5 and 6.
mAb CH12—Wang H., et al *FASEB J.* 2012 January; 26(1):73-80 (Shanghai Cancer Institute).
RAbDMvIII—Gupta P., et al *BMC Biotechnol.* 2010 Oct. 7; 10:72 (Stanford University Medical Center).
mAb Ua30—Ohman L., et al Tumour Biol. 2002 March-April; 23(2):61-9 (Uppsala University).
Han D G., et al *Nan Fang Yi Ke Da Xue Xue Bao.* 2010 January; 30(1):25-9 (Xi'an Jiaotong University).

(46) CD33 (CD33 Molecule)
Nucleotide
Genbank accession no. M_23197
Genbank version no. NM_23197.1 GI:180097
Genbank record update date: Jun. 23, 2010 08:47 AM
Polypeptide
Genbank accession no. AAA51948
Genbank version no. AAA51948.1 GI:188098
Genbank record update date: Jun. 23, 2010 08:47 AM
Cross-References
Simmons D., et al *J. Immunol.* 141 (8), 2797-2800 (1988)
Other Information
  Official Symbol: CD33
  Other Aliases: SIGLEC-3, SIGLEC3, p67
  Other Designations: CD33 antigen (gp67); gp67; myeloid cell surface antigen CD33; sialic acid binding Ig-like lectin 3; sialic acid-binding Ig-like lectin
Antibodies
  H195 (Lintuzumab)-Raza A., et al *Leuk Lymphoma.* 2009 August; 50(8):1336-44; U.S. Pat. No. 6,759,045 (Seattle Genetics/Immunomedics)
  mAb OKT9: Sutherland, D. R. et al. *Proc Natl Acad Sci USA* 78(7): 4515-4519 1981, Schneider, C., et al *J Biol Chem* 257, 8516-8522 (1982)
  mAb E6: Hoogenboom, H. R., et al *J Immunol* 144, 3211-3217 (1990)
  U.S. Pat. No. 6,590,088 (Human Genome Sciences)
    For example, SEQ ID NOs: 1 and 2 and ATCC accession no. 97521
  U.S. Pat. No. 7,557,189 (Immunogen)
    For example, an antibody or fragment thereof comprising a heavy chain variable region which comprises three CDRs having the amino acid sequences of SEQ ID NOs:1-3 and a light chain variable region comprising three CDRs having the amino acid sequences of SEQ ID NOs:4-6.

(47) CD19 (CD19 Molecule)
Nucleotide
Genbank accession no. NM_001178098
Genbank version no. NM_001178098.1 GI:296010920
Genbank record update date: Sep. 10, 2012 12:43 AM Polypeptide
Genbank accession no. NP_001171569
Genbank version no. NP_001171569.1 GI:296010921
Genbank record update date: Sep. 10, 2012 12:43 AM
Cross-References
Tedder T F., et al *J. Immunol.* 143 (2): 712-7 (1989)
Other Information
  Official Symbol: CD19
  Other Aliases: B4, CVID3
  Other Designations: B-lymphocyte antigen CD19; B-lymphocyte surface antigen B4; T-cell surface antigen Leu-12; differentiation antigen CD19
Antibodies
  Immunogen: HuB4—Al-Katib A M., et al *Clin Cancer Res.* 2009 Jun. 15; 15(12):4038-45.
  4G7: Kügler M., et al *Protein Eng Des Sel.* 2009 March; 22(3):135-47
    For example, sequences in FIG. 3 of of Knappik, A. et al. J Mol Biol 2000 February; 296(1):57-86
  AstraZeneca/MedImmune: MEDI-551—Herbst R., et al *J Pharmacol Exp Ther.* 2010 October; 335(1):213-22
  Glenmark Pharmaceuticals: GBR-401—Hou S., et al *Mol Cancer Ther November* 2011 10 (Meeting Abstract Supplement) C164
  U.S. Pat. No. 7,109,304 (Immunomedics)
    For example, an antibody comprising the sequence of hA19Vk (SEQ ID NO:7) and the sequence of hA19VH (SEQ ID NO:10)
  U.S. Pat. No. 7,902,338 (Immunomedics)
    For example, an antibody or antigen-binding fragment thereof that comprises the light chain complementarity determining region CDR sequences CDR1 of SEQ ID NO: 16 (KASQSVDYDGDSYLN); CDR2 of SEQ ID NO: 17 (DASNLVS); and CDR3 of SEQ ID NO: 18 (QQSTEDPWT) and the heavy chain CDR sequences CDR1 of SEQ ID NO: 19 (SYWMN); CDR2 of SEQ ID NO: 20 (QIWPGDGDTNYNGKFKG) and CDR3 of SEQ ID NO: 21 (RETTTVGRYYYAMDY) and also comprises human antibody framework (FR) and constant region sequences with one or more framework region amino acid residues substituted from the corresponding framework region sequences of the parent murine antibody, and wherein said substituted FR residues comprise the substitution of serine for phenylalanine at Kabat residue 91 of the heavy chain variable region.
  Medarex: MDX-1342—Cardarelli P M., et al *Cancer Immuno/Immunother.* 2010 February; 59(2):257-65.
  MorphoSys/Xencor: MOR-208/XmAb-5574—Zalevsky J., et al *Blood.* 2009 Apr. 16; 113(16):3735-43
  U.S. Pat. No. 7,968,687 (Seattle Genetics)
    An antibody or antigen-binding fragment comprising a heavy chain variable domain comprising the amino acid sequence of SEQ ID NO:9 and a light chain variable domain comprising the amino acid sequence of SEQ ID NO: 24.
  4G7 chim—Lang P., et al Blood. 2004 May 15; 103(10): 3982-5 (University of Tübingen)
    For example, FIG. 6 and SEQ ID No: 80 of US20120082664
  Zhejiang University School of Medicine: 2E8—Zhang J., et al J Drug Target. 2010 November; 18(9):675-8
(48) IL2RA (Interleukin 2 Receptor, Alpha); NCBI Reference Sequence: NM_000417.2);

Nucleotide
Genbank accession no. NM_000417
Genbank version no. NM_000417.2 GI:269973860
Genbank record update date: Sep. 9, 2012 04:59 PM
Polypeptide
Genbank accession no. NP_000408
Genbank version no. NP_000408.1 GI:4557667
Genbank record update date: Sep. 9, 2012 04:59 PM
Cross-References
Kuziel W. A., et al *J. Invest. Dermatol.* 94 (6 SUPPL), 27S-32S (1990)
Other Information
  Official Symbol: IL2RA
  Other Aliases: RP11-536K7.1, CD25, IDDM10, IL2R, TCGFR
  Other Designations: FIL-2 receptor subunit alpha; IL-2-RA; IL-2R subunit alpha; IL2-RA; TAC antigen; interleukin-2 receptor subunit alpha; p55
Antibodies
  U.S. Pat. No. 6,383,487 (Novartis/UCL: Baxilisimab [Simulect])
  U.S. Pat. No. 6,521,230 (Novartis/UCL: Baxilisimab [Simulect])
    For example, an antibody having an antigen binding site comprises at least one domain which comprises CDR1 having the amino acid sequence in SEQ. ID. NO: 7, CDR2 having the amino acid sequence in SEQ. ID. NO: 8, and CDR3 chaving the amino acid sequence in SEQ. ID. NO: 9; or said CDR1, CDR2 and CDR3 taken in sequence as a whole comprise an amino acid sequence which is at least 90% identical to SEQ. ID. NOs: 7, 8 and 9 taken in sequence as a whole.
  Daclizumab—Rech A J., et al *Ann N Y Acad Sci.* 2009 September; 1174:99-106 (Roche)
(49) AXL (AXL Receptor Tyrosine Kinase)
Nucleotide
Genbank accession no. M76125
Genbank version no. M76125.1 GI:292869
Genbank record update date: Jun. 23, 2010 08:53 AM
Polypeptide
Genbank accession no. AAA61243
Genbank version no. AAA61243.1 GI:29870
Genbank record update date: Jun. 23, 2010 08:53 AM
Cross-References
O'Bryan J. P., et al *Mol. Cell. Biol.* 11 (10), 5016-5031 (1991); Bergsagel P. L., et al *J. Immunol.* 148 (2), 590-596 (1992)
Other Information
  Official Symbol: AXL
  Other Aliases: JTK11, UFO
  Other Designations: AXL oncogene; AXL transforming sequence/gene; oncogene AXL; tyrosine-protein kinase receptor UFO
Antibodies
  YW327.6S2—Ye X., et al *Oncogene.* 2010 Sep. 23; 29(38):5254-64. (Genentech)
  BergenBio: BGB324 (http://www.bergenbio.com/BGB324)
(50) CD30—TNFRSF8 (Tumor necrosis factor receptor superfamily, member 8)
Nucleotide
Genbank accession no. M83554
Genbank version no. M83554.1 GI:180095
Genbank record update date: Jun. 23, 2010 08:53 AM Polypeptide
Genbank accession no. AAA51947
Genbank version no. AAA51947.1 GI:180096
Genbank record update date: Jun. 23, 2010 08:53 AM
Cross-References
Durkop H., et al *Cell* 68 (3), 421-427 (1992)
Other Information
   Official Symbol: TNFRSF8
   Other Aliases: CD30, D1S166E, Ki-1
   Other Designations: CD30L receptor; Ki-1 antigen; cytokine receptor CD30; lymphocyte activation antigen CD30; tumor necrosis factor receptor superfamily member 8
(51) BCMA (B-Cell Maturation Antigen)—TNFRSF17 (Tumor Necrosis Factor Receptor Superfamily, Member 17)
Nucleotide
Genbank accession no. Z29574
Genbank version no. Z29574.1 GI:471244
Genbank record update date: Feb. 2, 2011 10:40 AM
Polypeptide
Genbank accession no. CAA82690
Genbank version no. CAA82690.1 GI:471245
Genbank record update date: Feb. 2, 2011 10:40 AM
Cross-References
Laabi Y., et al Nucleic Acids Res. 22 (7), 1147-1154 (1994)
Other Information
   Official Symbol: TNFRSF17
   Other Aliases: BCM, BCMA, CD269
   Other Designations: B cell maturation antigen; B-cell maturation factor; B-cell maturation protein; tumor necrosis factor receptor superfamily member 17
(52) CT Ags-CTA (Cancer Testis Antigens)
Cross-References
Fratta E., et al. *Mol Oncol.* 2011 April; 5(2):164-82; Lim SH., at al *Am J Blood Res.* 2012; 2(1):29-35.
(53) CD174 (Lewis Y)—FUT3 (Fucosyltransferase 3 (Galactoside 3(4)-L-Fucosyltransferase, Lewis Blood Group)
Nucleotide
Genbank accession no. NM000149
Genbank version no. NM000149.3 GI:148277008
Genbank record update date: Jun. 26, 2012 04:49 PM
Polypeptide
Genbank accession no. NP_000140
Genbank version no. NP_000140.1 GI:4503809
Genbank record update date: Jun. 26, 2012 04:49 PM
Cross-References
Kukowska-Latallo, J. F., et al *Genes Dev.* 4 (8), 1288-1303 (1990)
Other Information
   Official Symbol: FUT3
   Other Aliases: CD174, FT3B, FucT-III, LE, Les
   Other Designations: Lewis F T; alpha-(1,3/1,4)-fucosyltransferase; blood group Lewis alpha-4-fucosyltransferase; fucosyltransferase III; galactoside 3(4)-L-fucosyltransferase
(54) CLEC14A (C-Type Lectin Domain Family 14, Member A; Genbank Accession No. NM175060)
Nucleotide
Genbank accession no. NM175060
Genbank version no. NM175060.2 GI:371123930
Genbank record update date: Apr. 1, 2012 03:34 PM
Polypeptide
Genbank accession no. NP_778230
Genbank version no. NP_778230.1 GI:28269707
Genbank record update date: Apr. 1, 2012 03:34 PM
Other Information
   Official Symbol: CLEC14A
  Other Aliases: UNQ236/PRO269, C14orf27, CEG1, EGFR-5
   Other Designations: C-type lectin domain family 14 member A; CIECT and EGF-like domain containing protein; epidermal growth factor receptor 5
(55) GRP78-HSPA5 (Heat Shock 70 kDa Protein 5 (Glucose-Regulated Protein, 78 kDa)
Nucleotide
Genbank accession no. NM005347
Genbank version no. NM005347.4 GI:305855105
Genbank record update date: Sep. 30, 2012 01:42 PM
Polypeptide
Genbank accession no. NP_005338
Genbank version no. NP_005338.1 GI:16507237
Genbank record update date: Sep. 30, 2012 01:42 PM
Cross-References
Ting J., et al *DNA* 7 (4), 275-286 (1988)
Other Information
   Official Symbol: HSPA5
   Other Aliases: BIP, GRP78, MIF2
   Other Designations: 78 kDa glucose-regulated protein; endoplasmic reticulum lumenal Ca(2+)-binding protein grp78; immunoglobulin heavy chain-binding protein
(56) CD70 (CD70 Molecule) L08096
Nucleotide
Genbank accession no. L08096
Genbank version no. L08096.1 GI:307127
Genbank record update date: Jun. 23, 2012 08:54 AM
Polypeptide
Genbank accession no. AAA36175
Genbank version no. AAA36175.1 GI:307128
Genbank record update date: Jun. 23, 2012 08:54 AM
Cross-References
Goodwin R. G., et al *Cell* 73 (3), 447-456 (1993)
Other Information
   Official Symbol: CD70
   Other Aliases: CD27L, CD27LG, TNFSF7
   Other Designations: CD27 ligand; CD27-L; CD70 antigen; Ki-24 antigen; surface antigen CD70; tumor necrosis factor (ligand) superfamily, member 7; tumor necrosis factor ligand superfamily member 7
Antibodies
   MDX-1411 against CD70 (Medarex)
   h1F6 (Oflazoglu, E., et al, Clin Cancer Res. 2008 Oct. 1; 14(19):6171-80; Seattle Genetics)
     For example, see US20060083736 SEQ ID NOs: 1, 2, 11 and 12 and FIG. 1.
(57) Stem Cell Specific Antigens. For Example:
   5T4 (see entry (63) below)
   CD25 (see entry (48) above)
   CD32
     Polypeptide
       Genbank accession no. ABK42161
       Genbank version no. ABK42161.1 GI:117616286
       Genbank record update date: Jul. 25, 2007 03:00 PM
   LGR5/GPR49
     Nucleotide
       Genbank accession no. NM_003667
       Genbank version no. NM_003667.2 GI:24475886
       Genbank record update date: Jul. 22, 2012 03:38 PM
     Polypeptide
       Genbank accession no. NP_003658
       Genbank version no. NP_003658.1 GI:4504379
       Genbank record update date: Jul. 22, 2012 03:38 PM
   Prominin/CD133
     Nucleotide
       Genbank accession no. NM_006017
       Genbank version no. NM_006017.2 GI:224994187
       Genbank record update date: Sep. 30, 2012 01:47 PM Polypeptide
    Genbank accession no. NP_006008
    Genbank version no. NP_006008.1 GI:5174387
    Genbank record update date: Sep. 30, 2012 01:47 PM

(58) ASG-5
Cross-References
(Smith L. M., et. al *AACR* 2010 *Annual Meeting* (abstract #2590); Gudas J. M., et. al. *AACR* 2010 *Annual Meeting* (abstract #4393)
Antibodies
    Anti-AGS-5 Antibody: M6.131 (Smith, L. M., et. al *AACR* 2010 *Annual Meeting* (abstract #2590)

(59) ENPP3 (Ectonucleotide Pyrophosphatase/Phosphodiesterase 3)
Nucleotide
Genbank accession no. AF005632
Genbank version no. AF005632.2 GI:4432589
Genbank record update date: Mar. 10, 2010 09:41 PM
Polypeptide
Genbank accession no. AAC51813
Genbank version no. AAC51813.1 GI:2465540
Genbank record update date: Mar. 10, 2010 09:41 PM
Cross-References
Jin-Hua P., et al *Genomics* 45 (2), 412-415 (1997)
Other Information
    Official Symbol: ENPP3
    Other Aliases: RP5-988G15.3, B10, CD203c, NPP3, PDIBETA, PDNP3
    Other Designations: E-NPP 3; dJ1005H11.3 (phosphodiesterase I/nucleotide pyrophosphatase 3); dJ914N13.3 (phosphodiesterase I/nucleotide pyrophosphatase 3); ectonucleotide pyrophosphatase/phosphodiesterase family member 3; gp130RB13-6; phosphodiesterase I beta; phosphodiesterase I/nucleotide pyrophosphatase 3; phosphodiesterase-I beta

(60) PRR4 (Proline Rich 4 (Lacrimal))
Nucleotide
Genbank accession no. NM_007244
Genbank version no. NM_007244.2 GI:154448885
Genbank record update date: Jun. 28, 2012 12:39 PM
Polypeptide
Genbank accession no. NP_009175
Genbank version no. NP_009175.2 GI:154448886
Genbank record update date: Jun. 28, 2012 12:39 PM
Cross-References
Dickinson D. P., et al *Invest. Ophthalmol. Vis. Sci.* 36 (10), 2020-2031 (1995)
Other Information
    Official Symbol: PRR4
    Other Aliases: LPRP, PROL4
    Other Designations: lacrimal proline-rich protein; nasopharyngeal carcinoma-associated proline-rich protein 4; proline-rich polypeptide 4; proline-rich protein 4

(61) GCC—GUCY2C (Guanylate Cyclase 2C (Heat Stable Enterotoxin Receptor)
Nucleotide
Genbank accession no. NM_004963
Genbank version no. NM_004963.3 GI:222080082
Genbank record update date: Sep. 2, 2012 01:50 PM
Polypeptide
Genbank accession no. NP_004954
Genbank version no. NP_004954.2 GI:222080083
Genbank record update date: Sep. 2, 2012 01:50 PM
Cross-References
De Sauvage F. J., et al *J. Biol. Chem.* 266 (27), 17912-17918 (1991); Singh S., et al *Biochem. Biophys. Res. Commun.* 179 (3), 1455-1463 (1991)
Other Information
    Official Symbol: GUCY2C
    Other Aliases: DIAR6, GUC2C, MUCIL, STAR
    Other Designations: GC-C; STA receptor; guanylyl cyclase C; hSTAR; heat-stable enterotoxin receptor; intestinal guanylate cyclase

(62) Liv-1—SLC39A6 (Solute Carrier Family 39 (Zinc Transporter), Member 6)
Nucleotide
Genbank accession no. U41060
Genbank version no. U41060.2 GI:12711792
Genbank record update date: Nov. 30, 2009 04:35 PM
Polypeptide
Genbank accession no. AAA96258
Genbank version no. AAA96258.2 GI:12711793
Genbank record update date: Nov. 30, 2009 04:35 PM
Cross-References
Taylor K M., et al *Biochim Biophys Acta.* 2003 Apr. 1; 1611(1-2):16-30
Other Information
    Official Symbol: SLC39A6
    Other Aliases: LIV-1
    Other Designations: LIV-1 protein, estrogen regulated; ZIP-6; estrogen-regulated protein LIV-1; solute carrier family 39 (metal ion transporter), member 6; solute carrier family 39 member 6; zinc transporter ZIP6; zrt- and Irt-like protein 6

(63) 5T4, Trophoblast Glycoprotein, TPBG—TPBG (Trophoblast Glycoprotein)
Nucleotide
Genbank accession no. AJ012159
Genbank version no. AJ012159.1 GI:3805946
Genbank record update date: Feb. 1, 2011 10:27 AM
Polypeptide
Genbank accession no. CAA09930
Genbank version no. CAA09930.1 GI:3805947
Genbank record update date: Feb. 1, 2011 10:27 AM
Cross-References
King K. W., et al *Biochim. Biophys. Acta* 1445 (3), 257-270 (1999)
Other Information
    Official Symbol: TPBG
    Other Aliases: 5T4, 5T4AG, M6P1
    Other Designations: 5T4 oncofetal antigen; 5T4 oncofetal trophoblast glycoprotein; 5T4 oncotrophoblast glycoprotein

(64) CD56—NCMA1 (Neural Cell Adhesion Molecule 1)
Nucleotide
Genbank accession no. NM_000615
Genbank version no. NM_000615.6 GI:336285433
Genbank record update date: Sep. 23, 2012 02:32 PM
Polypeptide
Genbank accession no. NP_000606
Genbank version no. NP_000606.3 GI:94420689
Genbank record update date: Sep. 23, 2012 02:32 PM
Cross-References
Dickson, G., et al, *Cell* 50 (7), 1119-1130 (1987)
Other Information
    Official Symbol: NCAM1
    Other Aliases: CD56, MSK39, NCAM
    Other Designations: antigen recognized by monoclonal antibody 5.1H11; neural cell adhesion molecule, NCAM Antibodies
   Immunogen: HuN901 (Smith S V., et al *Curr Opin Mol Ther.* 2005 August; 7(4):394-401)
      For example, see humanized from murine N901 antibody. See FIGS. 1b and 1e of Roguska, M. A., et al. Proc Natl Acad Sci USA February 1994; 91:969-973.
(65) CanAg (Tumor Associated Antigen CA242)
Cross-References
Haglund C., et al *Br J Cancer* 60:845-851, 1989; Baeckstrom D., et al *J Biol Chem* 266:21537-21547, 1991
Antibodies
   huC242 (Tolcher A W et al., *J Clin Oncol.* 2003 Jan. 15; 21(2):211-22; Immunogen)
      For example, see US20080138898A1 SEQ ID NO: 1 and 2
(66) FOLR1 (Folate Receptor 1)
Nucleotide
Genbank accession no. J05013
Genbank version no. J05013.1 GI:182417
Genbank record update date: Jun. 23, 2010 08:47 AM
Polypeptide
Genbank accession no. AAA35823
Genbank version no. AAA35823.1 GI:182418
Genbank record update date: Jun. 23, 2010 08:47 AM
Cross-References
Elwood P. C., et al *J. Biol. Chem.* 264 (25), 14893-14901 (1989)
Other Information
   Official Symbol: FOLR1
   Other Aliases: FBP, FOLR
   Other Designations: FR-alpha; KB cells FBP; adult folate-binding protein; folate binding protein; folate receptor alpha; folate receptor, adult; ovarian tumor-associated antigen MOv18
Antibodies
   M9346A—Whiteman K R., et al *Cancer Res Apr.* 15, 2012; 72(8 Supplement): 4628 (Immunogen)
(67) GPNMB (Glycoprotein (Transmembrane)nmb)
Nucleotide
Genbank accession no. X76534
Genbank version no. X76534.1 GI:666042
Genbank record update date: Feb. 2, 2011 10:10 AM
Polypeptide
Genbank accession no. CAA54044
Genbank version no. CAA54044.1 GI:666043
Genbank record update date: Feb. 2, 2011 10:10 AM
Cross-References
Weterman M. A., et al *Int. J. Cancer* 60 (1), 73-81 (1995)
Other Information
   Official Symbol: GPNMB
   Other Aliases: UNQ1725/PRO9925, HGFIN, NMB
   Other Designations: glycoprotein NMB; glycoprotein nmb-like protein; osteoactivin; transmembrane glycoprotein HGFIN; transmembrane glycoprotein NMB
Antibodies
   Celldex Therapeutics: CR011 (Tse K F., et al *Clin Cancer Res.* 2006 Feb. 15; 12(4):1373-82)
      For example, see EP1827492B1 SEQ ID NO: 22, 24, 26, 31, 33 and 35
(68) TIM-1—HAVCR1 (Hepatitis A Virus Cellular Receptor 1)
Nucleotide
Genbank accession no. AF043724
Genbank version no. AF043724.1 GI:2827453
Genbank record update date: Mar. 10, 2010 06:24 PM
Polypeptide
Genbank accession no. AAC39862
Genbank version no. AAC39862.1 GI:2827454
Genbank record update date: Mar. 10, 2010 06:24 PM
Cross-References
Feigelstock D., et al *J. Virol.* 72 (8), 6621-6628 (1998)
Other Information
   Official Symbol: HAVCR1
   Other Aliases: HAVCR, HAVCR-1, KIM-1, KIM1, TIM, TIM-1, TIM1, TIMD-1, TIMD1
   Other Designations: T cell immunoglobin domain and mucin domain protein 1; T-cell membrane protein 1; kidney injury molecule 1
(69) RG-1/Prostate Tumor Target Mindin—Mindin/RG-1
Cross-References
Parry R., et al Cancer Res. 2005 Sep. 15; 65(18):8397-405
(70) B7-H4—VTCN1 (V-Set Domain Containing T Cell Activation Inhibitor 1
Nucleotide
Genbank accession no. BX648021
Genbank version no. BX648021.1 GI:34367180
Genbank record update date: Feb. 2, 2011 08:40 AM
Cross-References
Sica G L., et al *Immunity.* 2003 June; 18(6):849-61
Other Information
   Official Symbol: VTCN1
   Other Aliases: RP11-229A19.4, B7-H4, B7H4, B7S1, B7X, B7h.5, PRO1291, VCTN1
   Other Designations: B7 family member, H4; B7 superfamily member 1; T cell costimulatory molecule B7x; T-cell costimulatory molecule B7x; V-set domain-containing T-cell activation inhibitor 1; immune costimulatory protein B7-H4
(71) PTK7 (PTK7 Protein Tyrosine Kinase 7)
Nucleotide
Genbank accession no. AF447176
Genbank version no. AF447176.1 GI:17432420
Genbank record update date: Nov. 28, 2008 01:51 PM
Polypeptide
Genbank accession no. AAL39062
Genbank version no. AAL39062.1 GI:17432421
Genbank record update date: Nov. 28, 2008 01:51 PM
Cross-References
Park S. K., et al *J. Biochem.* 119 (2), 235-239 (1996)
Other Information
   Official Symbol: PTK7
   Other Aliases: CCK-4, CCK4
   Other Designations: colon carcinoma kinase 4; inactive tyrosine-protein kinase 7; pseudo tyrosine kinase receptor 7; tyrosine-protein kinase-like 7
(72) CD37 (CD37 Molecule)
Nucleotide
Genbank accession no. NM_001040031
Genbank version no. NM_001040031.1 GI:91807109
Genbank record update date: Jul. 29, 2012 02:08 PM
Polypeptide
Genbank accession no. NP_001035120
Genbank version no. NP_001035120.1 GI:91807110
Genbank record update date: Jul. 29, 2012 02:08 PM
Cross-References
Schwartz-Albiez R., et al *J. Immunol.* 140 (3), 905-914 (1988)
Other Information
   Official Symbol: CD37
   Other Aliases: GP52-40, TSPAN26
   Other Designations: CD37 antigen; cell differentiation antigen 37; leukocyte antigen CD37; leukocyte surface antigen CD37; tetraspanin-26; tspan-26

Antibodies
  Boehringer Ingelheim: mAb 37.1 (Heider K H., et al *Blood.* 2011 Oct. 13; 118(15):4159-68)
  Trubion: CD37-SMIP (G28-1 scFv-Ig) ((Zhao X., et al *Blood.* 2007; 110: 2569-2577)
    For example, see US20110171208A1 SEQ ID NO: 253
    Immunogen: K7153A (Deckert J., et al Cancer Res Apr. 15, 2012; 72(8 Supplement): 4625)
(73) CD138—SDC1 (Syndecan 1)
Nucleotide
Genbank accession no. AJ551176
Genbank version no. AJ551176.1 GI:29243141
Genbank record update date: Feb. 1, 2011 12:09 PM
Polypeptide
Genbank accession no. CAD80245
Genbank version no. CAD80245.1 GI:29243142
Genbank record update date: Feb. 1, 2011 12:09 PM
Cross-References
O'Connell F P., et al *Am J Clin Pathol.* 2004 February; 121(2):254-63
Other Information
  Official Symbol: SDC1
  Other Aliases: CD138, SDC, SYND1, syndecan
  Other Designations: CD138 antigen; heparan sulfate proteoglycan fibroblast growth factor receptor; syndecan proteoglycan 1; syndecan-1
Antibodies
  Biotest: chimerized MAb (nBT062)—(Jagannath S., et al Poster ASH #3060, 2010; WIPO Patent Application WO/2010/128087)
    For example, see US20090232810 SEQ ID NO: 1 and 2
    Immunogen: B-B4 (Tassone P., et al *Blood* 104_3688-3696)
    For example, see US20090175863A1 SEQ ID NO: 1 and 2
(74) CD74 (CD74 Molecule, Major Histocompatibility Complex, Class II Invariant Chain)
Nucleotide
Genbank accession no. NM_004355
Genbank version no. NM_004355.1 GI:343403784
Genbank record update date: Sep. 23, 2012 02:30 PM
Polypeptide
Genbank accession no. NP_004346
Genbank version no. NP_004346.1 GI:10835071
Genbank record update date: Sep. 23, 2012 02:30 PM
Cross-References
Kudo, J., et al *Nucleic Acids Res.* 13 (24), 8827-8841 (1985)
Other Information
  Official Symbol: CD74
  Other Aliases: DHLAG, HLADG, II, Ia-GAMMA
  Other Designations: CD74 antigen (invariant polypeptide of major histocompatibility complex, class II antigen-associated); HLA class II histocompatibility antigen gamma chain; HLA-DR antigens-associated invariant chain; HLA-DR-gamma; Ia-associated invariant chain; MHC HLA-DR gamma chain; gamma chain of class II antigens; p33
Antibodies
  Immunomedics: hLL1 (Milatuzumab,)—Berkova Z., et al *Expert Opin Investig Drugs.* 2010 January; 19(1):141-9
    For example, see US20040115193 SEQ ID NOs: 19, 20, 21, 22, 23 and 24
  Genmab: HuMax-CD74 (see website)
(75) Claudins—CLs (Claudins)
Cross-References
Offner S., et al *Cancer Immunol Immunother.* 2005 May; 54(5):431-45, Suzuki H., et al *Ann N Y Acad Sci.* 2012 July; 1258:65-70)

In humans, 24 members of the family have been described—see literature reference.
(76) EGFR (Epidermal Growth Factor Receptor)
Nucleotide
Genbank accession no. NM_005228
Genbank version no. NM_005228.3 GI:41927737
Genbank record update date: Sep. 30, 2012 01:47 PM
Polypeptide
Genbank accession no. NP_005219
Genbank version no. NP_005219.2 GI:29725609
Genbank record update date: Sep. 30, 2012 01:47 PM
Cross-References
Dhomen N S., et al *Crit Rev Oncog.* 2012; 17(1):31-50
Other Information
  Official Symbol: EGFR
  Other Aliases: ERBB, ERBB1, HER1, PIG61, mENA
  Other Designations: avian erythroblastic leukemia viral (v-erb-b) oncogene homolog; cell growth inhibiting protein 40; cell proliferation-inducing protein 61; proto-oncogene c-ErbB-1; receptor tyrosine-protein kinase erbB-1
Antibodies
  BMS: Cetuximab (Erbitux)—Broadbridge V T., et al *Expert Rev Anticancer Ther.* 2012 May; 12(5):555-65.
    For example, see U.S. Pat. No. 6,217,866—ATTC deposit No. 9764.
  Amgen: Panitumumab (Vectibix)—Argiles G., et al *Future Oncol.* 2012 April; 8(4):373-89
    For example, see U.S. Pat. No. 6,235,883 SEQ ID NOs: 23-38.
  Genmab: Zalutumumab—Rivera F., et al *Expert Opin Biol Ther.* 2009 May; 9(5):667-74.
  Y M Biosciences: Nimotuzumab—Ramakrishnan M S., et al *MAbs.* 2009 January-February; 1(1):41-8.
    For example, see U.S. Pat. No. 5,891,996 SEQ ID NOs: 27-34.
(77) Her3 (ErbB3)—ERBB3 (v-Erb-b2 Erythroblastic Leukemia Viral Oncogene Homolog 3 (Avian))
Nucleotide
Genbank accession no. M34309
Genbank version no. M34309.1 GI:183990
Genbank record update date: Jun. 23, 2010 08:47 PM
Polypeptide
Genbank accession no. AAA35979
Genbank version no. AAA35979.1 GI:306841
Genbank record update date: Jun. 23, 2010 08:47 PM
Cross-References
Plowman, G. D., et al., *Proc. Natl. Acad. Sci. U.S.A.* 87 (13), 4905-4909 (1990)
Other Information
  Official Symbol: ERBB3
  Other Aliases: ErbB-3, HER3, LCCS2, MDA-BF-1, c-erbB-3, c-erbB3, erbB3-S, p180-ErbB3, p45-sErbB3, p85-sErbB3
  Other Designations: proto-oncogene-like protein c-ErbB-3; receptor tyrosine-protein kinase erbB-3; tyrosine kinase-type cell surface receptor HER3
Antibodies
  Merimack Pharma: MM-121 (Schoeberl B., et al Cancer Res. 2010 Mar. 15; 70(6):2485-2494)
    For example, see US2011028129 SEQ ID NOs: 1, 2, 3, 4, 5, 6, 7 and 8.
(78) RON—MST1R (Macrophage Stimulating 1 Receptor (c-Met-Related Tyrosine Kinase))
Nucleotide
Genbank accession no. X70040
Genbank version no. X70040.1 GI:36109
Genbank record update date: Feb. 2, 2011 10:17 PM Polypeptide
Genbank accession no. CCA49634
Genbank version no. CCA49634.1 GI:36110
Genbank record update date: Feb. 2, 2011 10:17 PM
Cross-References
Ronsin C., et al *Oncogene* 8 (5), 1195-1202 (1993)
Other Information
  Official Symbol: MST1R
  Other Aliases: CD136, CDw136, PTK8, RON
  Other Designations: MSP receptor; MST1R variant RON30; MST1R variant RON62; PTK8 protein tyrosine kinase 8; RON variant E2E3; c-met-related tyrosine kinase; macrophage-stimulating protein receptor; p185-Ron; soluble RON variant 1; soluble RON variant 2; soluble RON variant 3; soluble RONvariant 4
(79) EPHA2 (EPH Receptor A2)
Nucleotide
Genbank accession no. BC037166
Genbank version no. BC037166.2 GI:33879863
Genbank record update date: Mar. 6, 2012 01:59 PM
Polypeptide
Genbank accession no. AAH37166
Genbank version no. AAH37166.1 GI:22713539
Genbank record update date: Mar. 6, 2012 01:59 PM
Cross-References
Strausberg R. L., et al *Proc. Natl. Acad. Sci. U.S.A.* 99 (26), 16899-16903 (2002)
Other Information
  Official Symbol: EPHA2
  Other Aliases: ARCC2, CTPA, CTPP1, ECK
  Other Designations: ephrin type-A receptor 2; epithelial cell receptor protein tyrosine kinase; soluble EPHA2 variant 1; tyrosine-protein kinase receptor ECK
Antibodies
  Medimmune: 1C1 (Lee J W., et al *Clin Cancer Res.* 2010 May 1; 16(9):2562-2570)
    For example, see US20090304721A1 FIGS. 7 and 8.
(80) CD20—MS4A1 (Membrane-Spanning 4-Domains, Subfamily A, Member 1)
Nucleotide
Genbank accession no. M27394
Genbank version no. M27394.1 GI:179307
Genbank record update date: Nov. 30, 2009 11:16 AM
Polypeptide
Genbank accession no. AAA35581
Genbank version no. AAA35581.1 GI:179308
Genbank record update date: Nov. 30, 2009 11:16 AM
Cross-References
Tedder T. F., et al *Proc. Natl. Acad. Sci. U.S.A.* 85 (1), 208-212 (1988)
Other Information
  Official Symbol: MS4A1
  Other Aliases: B1, Bp35, CD20, CVID5, LEU-16, MS4A2, S7
  Other Designations: B-lymphocyte antigen CD20; B-lymphocyte cell-surface antigen B1; CD20 antigen; CD20 receptor; leukocyte surface antigen Leu-16
Antibodies
  Genentech/Roche: Rituximab—Abdulla N E., et al *BioDrugs.* 2012 Apr. 1; 26(2):71-82.
    For example, see U.S. Pat. No. 5,736,137, ATCC deposit No. HB-69119.
  GSK/Genmab: Ofatumumab—Nightingale G., et al Ann Pharmacother. 2011 October; 45(10):1248-55.
    For example, see US20090169550A1 SEQ ID NOs: 2, 4 and 5.
  Immunomedics: Veltuzumab—Goldenberg D M., et al *Leuk Lymphoma.* 2010 May; 51(5):747-55.
    For example, see US7919273B2 SEQ ID NOs: 1, 2, 3, 4, 5 and 6.
(81) Tenascin C—TNC (Tenascin C)
Nucleotide
Genbank accession no. NM_002160
Genbank version no. NM_002160.3 GI:340745336
Genbank record update date: Sep. 23, 2012 02:33 PM
Polypeptide
Genbank accession no. NP_002151
Genbank version no. NP_002151.2 GI:153946395
Genbank record update date: Sep. 23, 2012 02:33 PM
Cross-References
Nies D. E., et al *J. Biol. Chem.* 266 (5), 2818-2823 (1991); Siri A., et al *Nucleic Acids Res.* 19 (3), 525-531 (1991)
Other Information
  Official Symbol: TNC
  Other Aliases: 150-225, GMEM, GP, HXB, JI, TN, TN-C
  Other Designations: GP 150-225; cytotactin; glioma-associated-extracellular matrix antigen; hexabrachion (tenascin); myotendinous antigen; neuronectin; tenascin; tenascin-C isoform 14/AD1/16
Antibodies
  Philogen: G11 (von Lukowicz T., et al *J Nud Med.* 2007 April; 48(4):582-7) and F16 (Pedretti M., et al Lung Cancer. 2009 April; 64(1):28-33)
    For example, see U.S. Pat. No. 7,968,685 SEQ ID NOs: 29, 35, 45 and 47.
(82) FAP (Fibroblast Activation Protein, Alpha)
Nucleotide
Genbank accession no. U09278
Genbank version no. U09278.1 GI:1888315
Genbank record update date: Jun. 23, 2010 09:22 AM
Polypeptide
Genbank accession no. AAB49652
Genbank version no. AAB49652.1 GI:1888316
Genbank record update date: Jun. 23, 2010 09:22 AM
Cross-References
Scanlan, M. J., et al *Proc. Natl. Acad. Sci. U.S.A.* 91 (12), 5657-5661 (1994)
Other Information
  Official Symbol: FAP
  Other Aliases: DPPIV, FAPA
  Other Designations: 170 kDa melanoma membrane-bound gelatinase; integral membrane serine protease; seprase
(83) DKK-1 (Dickkopf 1 Homolog (*Xenopus laevis*))
Nucleotide
Genbank accession no. NM_012242
Genbank version no. NM_012242.2 GI:61676924
Genbank record update date: Sep. 30, 2012 01:48 PM
Polypeptide
Genbank accession no. NP_036374
Genbank version no. NP_036374.1 GI:7110719
Genbank record update date: Sep. 30, 2012 01:48 PM
Cross-References
Fedi P. et al *J. Biol. Chem.* 274 (27), 19465-19472 (1999)
Other Information
  Official Symbol: DKK1
  Other Aliases: UNQ492/PRO1008, DKK-1, SK
  Other Designations: dickkopf related protein-1; dickkopf-1 like; dickkopf-like protein 1; dickkopf-related protein 1; hDkk-1

Antibodies
Novartis: BHQ880 (Fulciniti M., et al *Blood.* 2009 Jul. 9; 114(2):371-379)
For example, see US20120052070A1 SEQ ID NOs: 100 and 108.

(84) CD52 (CD52 Molecule)
Nucleotide
Genbank accession no. NM_001803
Genbank version no. NM_001803.2 GI:68342029
Genbank record update date: Sep. 30, 2012 01:48 PM
Polypeptide
Genbank accession no. NP_001794
Genbank version no. NP_001794.2 GI:68342030
Genbank record update date: Sep. 30, 2012 01:48 PM
Cross-References
Xia M. Q., et al *Eur. J. Immunol.* 21 (7), 1677-1684 (1991)
Other Information
Official Symbol: CD52
Other Aliases: CDW52
Other Designations: CAMPATH-1 antigen; CD52 antigen (CAMPATH-1 antigen); CDW52 antigen (CAMPATH-1 antigen); cambridge pathology 1 antigen; epididymal secretory protein E5; he5; human epididymis-specific protein 5
Antibodies
Alemtuzumab (Campath)—Skoetz N., et al *Cochrane Database Syst Rev.* 2012 Feb. 15; 2:CD008078.
For example, see Drugbank Acc. No. DB00087 (BIOD00109, BTD00109)

(85) CS1—SLAMF7 (SLAM Family Member 7)
Nucleotide
Genbank accession no. NM_021181
Genbank version no. NM_021181.3 GI:1993571
Genbank record update date: Jun. 29, 2012 11:24 AM
Polypeptide
Genbank accession no. NP_067004
Genbank version no. NP_067004.3 GI:19923572
Genbank record update date: Jun. 29, 2012 11:24 AM
Cross-References
Boles K. S., et al *Immunogenetics* 52 (3-4), 302-307 (2001)
Other Information
Official Symbol: SLAMF7
Other Aliases: UNQ576/PRO1138, 19A, CD319, CRACC, CS1
Other Designations: 19A24 protein; CD2 subset 1; CD2-like receptor activating cytotoxic cells; CD2-like receptor-activating cytotoxic cells; membrane protein FOAP-12; novel LY9 (lymphocyte antigen 9) like protein; protein 19A
Antibodies
BMS: elotuzumab/HuLuc63 (Benson D M., et al *J Clin Oncol.* 2012 Jun. 1; 30(16):2013-2015)
For example, see US20110206701 SEQ ID NOs: 9, 10, 11, 12, 13, 14, 15 and 16.

(86) Endoglin—ENG (Endoglin)
Nucleotide
Genbank accession no. AF035753
Genbank version no. AF035753.1 GI:3452260
Genbank record update date: Mar. 10, 2010 06:36 PM
Polypeptide
Genbank accession no. AAC32802
Genbank version no. AAC32802.1 GI:3452261
Genbank record update date: Mar. 10, 2010 06:36 PM
Cross-References
Rius C., et al *Blood* 92 (12), 4677-4690 (1998)
Official Symbol: ENG
Other Information
Other Aliases: RP11-228B15.2, CD105, END, HHT1, ORW, ORW1
Other Designations: CD105 antigen

(87) Annexin A1—ANXA1 (Annexin A1)
Nucleotide
Genbank accession no. X05908
Genbank version no. X05908.1 GI:34387
Genbank record update date: Feb. 2, 2011 10:02 AM
Polypeptide
Genbank accession no. CCA29338
Genbank version no. CCA29338.1 GI:34388
Genbank record update date: Feb. 2, 2011 10:02 AM
Cross-References
Wallner B. P., et al *Nature* 320 (6057), 77-81 (1986)
Other Information
Official Symbol: ANXA1
Other Aliases: RP11-71A24.1, ANX1, LPC1
Other Designations: annexin I (lipocortin I); annexin-1; calpactin II; calpactin-2; chromobindin-9; lipocortin I; p35; phospholipase A2 inhibitory protein

(88) V-CAM (CD106)—VCAM1 (Vascular Cell Adhesion Molecule 1)
Nucleotide
Genbank accession no. M60335
Genbank version no. M60335.1 GI:340193
Genbank record update date: Jun. 23, 2010 08:56 AM
Polypeptide
Genbank accession no. AAA61269
Genbank version no. AAA61269.1 GI:340194
Genbank record update date: Jun. 23, 2010 08:56 AM
Cross-References
Hession C., et al *J. Biol. Chem.* 266 (11), 6682-6685 (1991)
Other Information
Official Symbol VCAM1
Other Aliases: CD106, INCAM-100
Other Designations: CD106 antigen; vascular cell adhesion protein 1

```
                           Antibody Sequences

Anti-Integrin avβ6
RHAB6.2
QVQLVQSGSELKKPGASVKISCKASGFAFTDSYMHWVRQAPGQGLEWMGWIDPENGDTEYAPKFQGRFV
FSLDTSVSTAYLQISSLKAEDTAVYYCTRGTPTAVPNLRGDLQVLAQKVAGPYPFDYWGQGTLVTVSS RHCB6.2
QVQLVQSGAEVKKPGASVKVSCKASGYTFIDSYMHWVRQAPGQRLEWMGWIDPENGDTEYAPKFQGRVT
ITTDTSASTAYMELSSLRSEDTAVYYCARGTPTAVPNLRGDLQVLAQKVAGPYPFDYWGQGTLVTVSS RHF
QVQLVQSGAEVKKPGASVKVSCKASGFNFIDSYMHWVRQAPGQRLEWMGWIDPENGDTEYAPKFQGRVT
FTTDTSASTAYMELSSLRSEDTAVYYCNEGTPTGPYYFDYWGQGTLVTVSS
```

| Antibody Sequences |
| --- |

RHFB6
QVQLVQSGAEVKKPGASVKVSCKASGFNFIDSYMHWVRQAPGQRLEWMGWIDPENGDTEYAPKFQGRVT
FTTDTSASTAYMELSSLRSEDTAVYYCNEGTPTAVPNLRGDLQVLAQKVAGPYYFDYWGQGTLVTVSS

RHAY100bP
QVQLVQSGSELKKPGASVKISCKASGFAFTDSYMHWVRQAPGQGLEWMGWIDPENGDTEYAPKFQGRFV
FSLDTSVSTAYLQISSLKAEDTAVYYCTRGTPTGPYPFDYWGQGTLVTVSS

RKF
ENVLTQSPGTLSLSPGERATLSCSASSSVSYMHWFQQKPGQAPRLLIYSTSNLASGIPDRFSGSGSGTD
FTLTISRLEPEDFAVYYCQQRSSYPLTFGGGTKVEIK

RKFL36L50
ENVLTQSPGTLSLSPGERATLSCSASSSVSYMHWLQQKPGQAPRLLIYLTSNLASGIPDRFSGSGSGTD
FTLTISRLEPEDFAVYYCQQRSSYPLTFGGGTKVEIK

RKC
EIVLTQSPGTLSLSPGERATLSCSASSSVSYMHWFQQKPGQAPRLLIYSTSNLASGIPDRFSGSGSGTD
FTLTISRLEPEDFAVYYCQQRSSYPLTFGGGTKVEIK

Anti-CD33
CD33 Hum195 VH
QVQLVQSGAEVKKPGSSVKVSCKASGYTFTDYNMHWVRQAPGQGLEWIGYIYPYNGGTGYNQKFKSKAT
ITADESTNTAYMELSSLRSEDTAVYYCARGRPAMDYWGQGTLVTVSS CD33 Hum195 VK
DIQMTQSPSSLSASVGDRVTITCRASESVDNYGISFMNWFQQKPGKAPKLLIYAASNQGSGVPSRFSGS
GSGTDFTLTISSLQPDDFATYYCQQSKEVPWTFGQGTKVEIK Anti-CD19
CD19 B4 resurfaced VH
QVQLVQPGAEVVKPGASVKLSCKTSGYTFTSNWMHWVKQRPGQGLEWIGEIDPSDSYTNYNQNFKGKAK
LTVDKSTSTAYMEVSSLRSDDTAVYYCARGSNPYYYAMDYWGQGTSVTVSS CD19 B4 resurfaced VK
EIVLTQSPAIMSASPGERVTMTCSASSGVNYMHWYQQKPGTSPRRWIYDTSKLASGVPARFSGSGSGTS
YSLTISSMEPEDAATYYCHQRGSYTFGGGTKLEIK Anti-Her2
Herceptin VH chain
EVQLVESGGGLVQPGGSLRLSCAASGFNIKDTYIHWVRQAPGKGLEWVARIYPTNGYTRYADSVKGRFT
ISADTSKNTAYLQMNSLRAEDTAVYYCSRWGGDGFYAMDYWGQGTLVTVSS Herceptin VL chain
DIQMTQSPSSLSASVGDRVTITCRASQDVNTAVAWYQQKPGKAPKLLIYSASFLYSGVPSRFSGSRSGT
DFTLTISSLQPEDFATYYCQQHYTTPPTFGQGTKVEIK Anti-CD25
Simulect VK (also known as Basiliximab)
QIVSTQSPAIMSASPGEKVTMTCSASSSRSYMQWYQQKPGTSPKRWIYDTSKLASGVPARFSGSGSGTS
YSLTISSMEAEDAATYYCHQRSSYTFGGGTKLEIK Simulect VH
QLQQSGTVLARPGASVKMSCKASGYSFTRYWMHWIKQRPGQGLEWIGAIYPGNSDTSYNQKFEGKAKLT
AVTSASTAYMELSSLTHEDSAVYYCSRDYGYYFDFWGQGTTLTVSS Anti-PSMA
Deimmunised VH '1
EVQLVQSGPEVKKPGATVKISCKTSGYTFTEYTIHWVKQAPGKGLEWIGNINPNNGGTTYNQKFEDKAT
LTVDKSTDTAYMELSSLRSEDTAVYYCAAGWNFDYWGQGTLLTVSS Deimmunised VK '1
DIQMTQSPSSLSTSVGDRVTLTCKASQDVGTAVDWYQQKPGPSPKLLIYWASTRHTGIPSRFSGSGSGT
DFTLTISSLQPEDFADYYCQQYNSYPLTFGPGTKVDIK Deimmunised VH1 '5
EVKLVESGGGLVQPGGSMKLSCVASGFTFSNYWMNWVRQAPGKGLEWVAEIRSQSNNFATHYAESVKGR
VTISRDDSKSIVYLQMNNLRAEDTGVYYCTRRWNNFWGQGTTVTVSS Deimmunised VH2 '5
EVKLVESGGGLVQPGGSLKLSCVASGFTFSNYWMNWVRQAPGKGLEWVAEIRSQSNNFATHYAESVKGR
VTISRDDSKSIVYLQMNNLRAEDTAVYYCTRRWNNFWGQGTTVTVSS Deimmunised VH3 '5
EVQLVESGGGLVQPGGSLKLSCVASGFTFSNYWMNWVRQAPGKGLEWVAEIRSQSNNFATHYAESVKGR
VTISRDDSKSIVYLQMNNLRAEDTAVYYCTRRWNNFWGQGTTVTVSS

| Antibody Sequences |
| --- |

Deimmunised VH4 '5
EVQLVESGGGLVQPGGSLKLSCVASGFTFSNYWMNWVRQAPGKGLEWVAEIRSQSNNFATHYAESVKGR
FTISRDDSKSIVYLQMNNLRAEDTAVYYCTRRWNNFWGQGTTVTVSS Deimmunised VK1 '5
NIVMTQFPSSMSASVGDRVTITCKASENVGTYVSWYQQKPDQSPKMLIYGASNRFTGVPDRFTGSGSAT
DFTLTISSLQTEDLADYYCGQSYTFPYTFGQGTKLEMK Deimmunised VK2 '5
NIVMTQFPSSMSASVGDRVTITCKASENVGTYVSWYQQKPDQSPKMLIYGASNRFTGVPDRFSGSGSGT
DFTLTISSLQAEDLADYYCGQSYTFPYTFGQGTKLEIK Deimmunised VK3 '5
NIQMTQFPSAMSASVGDRVTITCKASENVGTYVSWYQQKPDQSPKMLIYGASNRFTGVPDRFSGSGSGT
DFTLTISSLQAEDLADYYCGQSYTFPYTFGQGTKLEIK Deimmunised VK4 '5
NIQMTQFPSAMSASVGDRVTITCKASENVGTYVSWYQQKPDQSPKMLIYGASNRFTGVPDRFSGSGSGT
DFTLTISSLQAEDEADYYCGQSYTFPYTFGQGTKLEIK Deimmunised VK DI '5
NIVMTQFPKSMSASAGERMTLTCKASENVGTYVSWYQQKPTQSPKMLIYGASNRFTGVPDRFSGSGSGT
DFILTISSVQAEDLVDYYCGQSYTFPYTFGGGTKLEMK Deimmunised VH DI '5
EVKLEESGGGLVQPGGSMKISCVASGFTFSNYWMNWVRQSPEKGLEWVAEIRSQSNNFATHYAESVKGR
VIISRDDSKSSVYLQMNSLRAEDTAVYYCTRRWNNFWGQGTTVTVSS Humanised RHA '5
EVQLVESGGGLVQPGGSLKLSCAASGFTFSNYWMNWVRQASGKGLEWVGEIRSQSNNFATHYAESVKGR
FTISRDDSKNTAYLQMNSLKTEDTAVYYCTRRWNNFWGQGTTVTVSS Humanised RHB '5
EVKLVESGGGLVQPGGSLKLSCAASGFTFSNYWMNWVRQASGKGLEWVAEIRSQSNNFATHYAESVKGR
VIISRDDSKNTVYLQMNSLRTEDTAVYYCTRRWNNFWGQGTTVTVSS Humanised RHC '5
EVQLVESGGGLVQPGGSLKLSCAASGFTFSNYWMNWVRQASGKGLEWVAEIRSQSNNFATHYAESVKGR
VIISRDDSKNTVYLQMNSLRTEDTAVYYCTRRWNNFWGQGTTVTVSS Humanised RHD '5
EVKLVESGGGLVQPGGSLKLSCAASGFTFSNYWMNWVRQASGKGLEWVGEIRSQSNNFATHYAESVKGR
VIISRDDSKNTVYLQMNSLRTEDTAVYYCTRRWNNFWGQGTTVTVSS Humanised RHE '5
EVKLVESGGGLVQPGGSLKLSCAASGFTFSNYWMNWVRQASGKGLEWVAEIRSQSNNFATHYAESVKGR
FTISRDDSKNTVYLQMNSLRTEDTAVYYCTRRWNNFWGQGTTVTVSS Humanised RHF '5
EVKLVESGGGLVQPGGSLKLSCAASGFTFSNYWMNWVRQASGKGLEWVAEIRSQSNNFATHYAESVKGR
VIISRDDSKNTAYLQMNSLRTEDTAVYYCTRRWNNFWGQGTTVTVSS Humanised RHG '5
EVKLVESGGGLVQPGGSLKLSCAASGFTFSNYWMNWVRQASGKGLEWVAEIRSQSNNFATHYAESVKGR
VIISRDDSKNTAYLQMNSLRTEDTAVYYCTRRWNNFWGQGTTVTVSS Humanised RKA '5
DIQMTQSPSSVSASVGDRVTITCKASENVGTYVSWYQQKPGTAPKWYGASNRFTGVPSRFSGSGSATDF
TLTINNLQPEDFATYYCGQSYTFPYTFGQGTKVEIK Humanised RKB '5
DIQMTQSPSSVSASVGDRVTITCKASENVGTYVSWYQQKPGTAPKWYGASNRFTGVPSRFSGSGSATDF
TLTINNLQPEDFATYYCGQSYTFPYTFGQGTKVEIK Humanised RKC '5
DIQMTQSPSSVSASVGDRVTITCKASENVGTYVSWYQQKPGTAPKMLIYGASNRFTGVPSRFSGSGSAT
DFTLTINNLQPEDFATYYCGQSYTFPYTFGQGTKVEIK Humanised RKD '5
DIQMTQSPSSVSASVGDRVTITCKASENVGTYVSWYQQKPGTAPKMLIYGASNRFTGVPSRFSGSGSAT
DFTLTINNLQPEDFATYYCGQSYTFPYTFGQGTKVEIK Humanised RKE '5
NIVMTQSPSSVSASVGDRVTITCKASENVGTYVSWYQQKPGTAPKLLIYGASNRFTGVPDRFTGSGSAT
DFILTINNLQPEDFATYYCGQSYTFPYTFGQGTKVEIK

Antibody Sequences

Humanised RKF '5
NIVMTQSPSSVSASVGDRVTITCKASENVGTYVSWYQQKPGTAPKMLIYGASNRFTGVPSRFSGSGSAT
DFILTINNLQPEDFATYYCGQSYTFPYTFGQGTKVEIK Humanised RKG '5
NIVMTQSPSSVSASVGDRVTITCKASENVGTYVSWYQQKPGTAPKMLIYGASNRFTGVPDRFTGSGSAT
DFTLTINNLQPEDFATYYCGQSYTFPYTFGQGTKVEIK The parent antibody may also be a fusion protein comprising an albumin-binding peptide (ABP) sequence (Dennis et al. (2002) "Albumin Binding As A General Strategy For Improving The Pharmacokinetics Of Proteins" *J Biol Chem.* 277:35035-35043; WO 01/45746). Antibodies of the invention include fusion proteins with ABP sequences taught by: (i) Dennis et al (2002) *J Biol Chem.* 277:35035-35043 at Tables III and IV, page 35038; (ii) US 2004/0001827 at [0076]; and (iii) WO 01/45746 at pages 12-13, and all of which are incorporated herein by reference.

In one embodiment, the antibody has been raised to target specific the tumour related antigen $\alpha_v\beta_6$.

The cell binding agent may be labelled, for example to aid detection or purification of the agent either prior to incorporation as a conjugate, or as part of the conjugate. The label may be a biotin label. In another embodiment, the cell binding agent may be labelled with a radioisotope.

The cell binding agent is connected to the linker. In one embodiment, the cell binding agent is connected to A, where present, of the linker.

In one embodiment, the connection between the cell binding agent and the linker is through a thioether bond.

In one embodiment, the connection between the cell binding agent and the linker is through a disulfide bond.

In one embodiment, the connection between the cell binding agent and the linker is through an amide bond.

In one embodiment, the connection between the cell binding agent and the linker is through an ester bond.

In one embodiment, the connection between the cell binding agent and the linker is formed between a thiol group of a cysteine residue of the cell binding agent and a maleimide group of the linker.

The cysteine residues of the cell binding agent may be available for reaction with the functional group of $R^L$ to form a connection. In other embodiments, for example where the cell binding agent is an antibody, the thiol groups of the antibody may participate in interchain disulfide bonds. These interchain bonds may be converted to free thiol groups by e.g. treatment of the antibody with DTT prior to reaction with the functional group of $R^L$.

The cell binding agent may be labelled, for example to aid detection or purification of the agent either prior to incorporation as a conjugate, or as part of the conjugate. The label may be a biotin label. In another embodiment, the cell binding agent may be labelled with a radioisotope.

Drug Loading

The drug loading is the average number of PBD drugs per cell binding agent, e.g. antibody. Where the compounds of the invention are bound to cysteines, drug loading may range from 1 to 8 drugs (D) per cell binding agent, i.e. where 1, 2, 3, 4, 5, 6, 7, and 8 drug moieties are covalently attached to the cell binding agent. Compositions of conjugates include collections of cell binding agents, e.g. antibodies, conjugated with a range of drugs, from 1 to 8. Where the compounds of the invention are bound to lysines, drug loading may range from 1 to 80 drugs (D) per cell binding agent, although an upper limit of 40, 20, 10 or 8 may be preferred. Compositions of conjugates include collections of cell binding agents, e.g. antibodies, conjugated with a range of drugs, from 1 to 80, 1 to 40, 1 to 20, 1 to 10 or 1 to 8.

The average number of drugs per antibody in preparations of ADC from conjugation reactions may be characterized by conventional means such as UV, reverse phase HPLC, HIC, mass spectroscopy, ELISA assay, and electrophoresis. The quantitative distribution of ADC in terms of p may also be determined. By ELISA, the averaged value of p in a particular preparation of ADC may be determined (Hamblett et al (2004) Clin. Cancer Res. 10:7063-7070; Sanderson et al (2005) Clin. Cancer Res. 11:843-852). However, the distribution of p (drug) values is not discernible by the antibody-antigen binding and detection limitation of ELISA. Also, ELISA assay for detection of antibody-drug conjugates does not determine where the drug moieties are attached to the antibody, such as the heavy chain or light chain fragments, or the particular amino acid residues. In some instances, separation, purification, and characterization of homogeneous ADC where p is a certain value from ADC with other drug loadings may be achieved by means such as reverse phase HPLC or electrophoresis. Such techniques are also applicable to other types of conjugates.

For some antibody-drug conjugates, p may be limited by the number of attachment sites on the antibody. For example, an antibody may have only one or several cysteine thiol groups, or may have only one or several sufficiently reactive thiol groups through which a linker may be attached. Higher drug loading, e.g. p>5, may cause aggregation, insolubility, toxicity, or loss of cellular permeability of certain antibody-drug conjugates.

Typically, fewer than the theoretical maximum of drug moieties are conjugated to an antibody during a conjugation reaction. An antibody may contain, for example, many lysine residues that do not react with the drug-linker intermediate (D-L) or linker reagent. Only the most reactive lysine groups may react with an amine-reactive linker reagent. Also, only the most reactive cysteine thiol groups may react with a thiol-reactive linker reagent. Generally, antibodies do not contain many, if any, free and reactive cysteine thiol groups which may be linked to a drug moiety. Most cysteine thiol residues in the antibodies of the compounds exist as disulfide bridges and must be reduced with a reducing agent such as dithiothreitol (DTT) or TCEP, under partial or total reducing conditions. The loading (drug/antibody ratio) of an ADC may be controlled in several different manners, including: (i) limiting the molar excess of drug-linker intermediate (D-L) or linker reagent relative to antibody, (ii) limiting the conjugation reaction time or temperature, and (iii) partial or limiting reductive conditions for cysteine thiol modification.

Certain antibodies have reducible interchain disulfides, i.e. cysteine bridges. Antibodies may be made reactive for conjugation with linker reagents by treatment with a reducing agent such as DTT (dithiothreitol). Each cysteine bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol. Reactive thiol groups may be introduced into the antibody (or fragment thereof) by engineering one, two, three, four, or more cysteine residues (e.g., preparing mutant antibodies comprising one or more non-native cysteine amino acid residues). U.S. Pat. No. 7,521,541 teaches engineering antibodies by introduction of reactive cysteine amino acids.

Cysteine amino acids may be engineered at reactive sites in an antibody and which do not form intrachain or intermolecular disulfide linkages (Junutula, et al., 2008b Nature Biotech., 26(8):925-932; Dornan et al (2009) Blood 114 (13):2721-2729; U.S. Pat. No. 7,521,541; U.S. Pat. No. 7,723,485; WO2009/052249). The engineered cysteine thiols may react with linker reagents or the drug-linker reagents of the present invention which have thiol-reactive, electrophilic groups such as maleimide or alpha-halo amides to form ADC with cysteine engineered antibodies and the PBD drug moieties. The location of the drug moiety can thus be designed, controlled, and known. The drug loading can be controlled since the engineered cysteine thiol groups typically react with thiol-reactive linker reagents or drug-linker reagents in high yield. Engineering an IgG antibody to introduce a cysteine amino acid by substitution at a single site on the heavy or light chain gives two new cysteines on the symmetrical antibody. A drug loading near 2 can be achieved with near homogeneity of the conjugation product ADC.

Where more than one nucleophilic or electrophilic group of the antibody reacts with a drug-linker intermediate, or linker reagent followed by drug moiety reagent, then the resulting product is a mixture of ADC compounds with a distribution of drug moieties attached to an antibody, e.g. 1, 2, 3, etc. Liquid chromatography methods such as polymeric reverse phase (PLRP) and hydrophobic interaction (HIC) may separate compounds in the mixture by drug loading value. Preparations of ADC with a single drug loading value (p) may be isolated, however, these single loading value ADCs may still be heterogeneous mixtures because the drug moieties may be attached, via the linker, at different sites on the antibody.

Thus the antibody-drug conjugate compositions of the invention include mixtures of antibody-drug conjugate compounds where the antibody has one or more PBD drug moieties and where the drug moieties may be attached to the antibody at various amino acid residues.

In one embodiment, the average number of dimer pyrrolobenzodiazepine groups per cell binding agent is in the range 1 to 20. In some embodiments the range is selected from 1 to 8, 2 to 8, 2 to 6, 2 to 4, and 4 to 8.

In some embodiments, there is one dimer pyrrolobenzodiazepine group per cell binding agent.

Use

The Compounds and Conjugates can be used to treat proliferative disease and autoimmune disease. The term "proliferative disease" pertains to an unwanted or uncontrolled cellular proliferation of excessive or abnormal cells which is undesired, such as, neoplastic or hyperplastic growth, whether in vitro or in vivo.

Examples of proliferative conditions include, but are not limited to, benign, pre-malignant, and malignant cellular proliferation, including but not limited to, neoplasms and tumours (e.g. histocytoma, glioma, astrocyoma, osteoma), cancers (e.g. lung cancer, small cell lung cancer, gastrointestinal cancer, bowel cancer, colon cancer, breast carinoma, ovarian carcinoma, prostate cancer, testicular cancer, liver cancer, kidney cancer, bladder cancer, pancreas cancer, brain cancer, sarcoma, osteosarcoma, Kaposi's sarcoma, melanoma), leukemias, psoriasis, bone diseases, fibroproliferative disorders (e.g. of connective tissues), and atherosclerosis. Cancers of particular interest include, but are not limited to, leukemias and ovarian cancers.

Any type of cell may be treated, including but not limited to, lung, gastrointestinal (including, e.g. bowel, colon), breast (mammary), ovarian, prostate, liver (hepatic), kidney (renal), bladder, pancreas, brain, and skin.

In one embodiment, the treatment is of a pancreatic cancer.

In one embodiment, the treatment is of a tumour having $\alpha_v\beta_6$ integrin on the surface of the cell.

It is contemplated that the antibody-drug conjugates (ADC) of the present invention may be used to treat various diseases or disorders, e.g. characterized by the overexpression of a tumor antigen. Exemplary conditions or hyperproliferative disorders include benign or malignant tumors; leukemia, haematological, and lymphoid malignancies. Others include neuronal, glial, astrocytal, hypothalamic, glandular, macrophagal, epithelial, stromal, blastocoelic, inflammatory, angiogenic and immunologic, including autoimmune, disorders.

Generally, the disease or disorder to be treated is a hyperproliferative disease such as cancer. Examples of cancer to be treated herein include, but are not limited to, carcinoma, lymphoma, blastoma, sarcoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, as well as head and neck cancer.

Autoimmune diseases for which the ADC compounds may be used in treatment include rheumatologic disorders (such as, for example, rheumatoid arthritis, Sjögren's syndrome, scleroderma, lupus such as SLE and lupus nephritis, polymyositis/dermatomyositis, cryoglobulinemia, antiphospholipid antibody syndrome, and psoriatic arthritis), osteoarthritis, autoimmune gastrointestinal and liver disorders (such as, for example, inflammatory bowel diseases (e.g. ulcerative colitis and Crohn's disease), autoimmune gastritis and pernicious anemia, autoimmune hepatitis, primary biliary cirrhosis, primary sclerosing cholangitis, and celiac disease), vasculitis (such as, for example, ANCA-associated vasculitis, including Churg-Strauss vasculitis, Wegener's granulomatosis, and polyarteriitis), autoimmune neurological disorders (such as, for example, multiple sclerosis, opsoclonus myoclonus syndrome, myasthenia gravis, neuromyelitis optica, Parkinson's disease, Alzheimer's disease, and autoimmune polyneuropathies), renal disorders (such as, for example, glomerulonephritis, Goodpasture's syndrome, and Berger's disease), autoimmune dermatologic disorders (such as, for example, psoriasis, urticaria, hives,

*pemphigus vulgaris*, bullous pemphigoid, and cutaneous lupus erythematosus), hematologic disorders (such as, for example, thrombocytopenic purpura, thrombotic thrombocytopenic purpura, post-transfusion purpura, and autoimmune hemolytic anemia), atherosclerosis, uveitis, autoimmune hearing diseases (such as, for example, inner ear disease and hearing loss), Behcet's disease, Raynaud's syndrome, organ transplant, and autoimmune endocrine disorders (such as, for example, diabetic-related autoimmune diseases such as insulin-dependent diabetes mellitus (IDDM), Addison's disease, and autoimmune thyroid disease (e.g. Graves' disease and thyroiditis)). More preferred such diseases include, for example, rheumatoid arthritis, ulcerative colitis, ANCA-associated vasculitis, lupus, multiple sclerosis, Sjögren's syndrome, Graves' disease, IDDM, pernicious anemia, thyroiditis, and glomerulonephritis.

Methods of Treatment

The conjugates of the present invention may be used in a method of therapy. Also provided is a method of treatment, comprising administering to a subject in need of treatment a therapeutically-effective amount of a conjugate compound of the invention. The term "therapeutically effective amount" is an amount sufficient to show benefit to a patient. Such benefit may be at least amelioration of at least one symptom. The actual amount administered, and rate and time-course of administration, will depend on the nature and severity of what is being treated. Prescription of treatment, e.g. decisions on dosage, is within the responsibility of general practitioners and other medical doctors.

A compound of the invention may be administered alone or in combination with other treatments, either simultaneously or sequentially dependent upon the condition to be treated. Examples of treatments and therapies include, but are not limited to, chemotherapy (the administration of active agents, including, e.g. drugs, such as chemotherapeutics); surgery; and radiation therapy.

A "chemotherapeutic agent" is a chemical compound useful in the treatment of cancer, regardless of mechanism of action. Classes of chemotherapeutic agents include, but are not limited to: alkylating agents, antimetabolites, spindle poison plant alkaloids, cytotoxic/antitumor antibiotics, topoisomerase inhibitors, antibodies, photosensitizers, and kinase inhibitors. Chemotherapeutic agents include compounds used in "targeted therapy" and conventional chemotherapy.

Examples of chemotherapeutic agents include: erlotinib (TARCEVA®, Genentech/OSI Pharm.), docetaxel (TAXOTERE®, Sanofi-Aventis), 5-FU (fluorouracil, 5-fluorouracil, CAS No. 51-21-8), gemcitabine (GEMZAR®, Lilly), PD-0325901 (CAS No. 391210-10-9, Pfizer), cisplatin (cis-diamine, dichloroplatinum(II), CAS No. 15663-27-1), carboplatin (CAS No. 41575-94-4), paclitaxel (TAXOL®, Bristol-Myers Squibb Oncology, Princeton, N.J.), trastuzumab (HERCEPTIN®, Genentech), temozolomide (4-methyl-5-oxo-2,3,4,6,8-pentazabicyclo[4.3.0]nona-2,7,9-triene-9-carboxamide, CAS No. 85622-93-1, TEMODAR®, TEMODAL®, Schering Plough), tamoxifen ((Z)-2-[4-(1,2-diphenylbut-1-enyl)phenoxy]-N,N-dimethylethanamine, NOLVADEX®, ISTUBAL®, VALODEX®), and doxorubicin (ADRIAMYCIN®), Akti-1/2, HPPD, and rapamycin.

More examples of chemotherapeutic agents include: oxaliplatin (ELOXATIN®, Sanofi), bortezomib (VELCADE®, Millennium Pharm.), sutent (SUNITINIB®, SU11248, Pfizer), letrozole (FEMARA®, Novartis), imatinib mesylate (GLEEVEC®, Novartis), XL-518 (Mek inhibitor, Exelixis, WO 2007/044515), ARRY-886 (Mek inhibitor, AZD6244, Array BioPharma, Astra Zeneca), SF-1126 (PI3K inhibitor, Semafore Pharmaceuticals), BEZ-235 (PI3K inhibitor, Novartis), XL-147 (PI3K inhibitor, Exelixis), PTK787/ZK 222584 (Novartis), fulvestrant (FASLODEX®, AstraZeneca), leucovorin (folinic acid), rapamycin (sirolimus, RAPAMUNE®, Wyeth), lapatinib (TYKERB®, GSK572016, Glaxo Smith Kline), lonafarnib (SARASAR™, SCH 66336, Schering Plough), sorafenib (NEXAVAR®, BAY43-9006, Bayer Labs), gefitinib (IRESSA®, AstraZeneca), irinotecan (CAMPTOSAR®, CPT-11, Pfizer), tipifarnib (ZARNESTRA™, Johnson & Johnson), ABRAXANE™ (Cremophor-free), albumin-engineered nanoparticle formulations of paclitaxel (American Pharmaceutical Partners, Schaumberg, Il), vandetanib (rINN, ZD6474, ZACTIMA®, AstraZeneca), chloranmbucil, AG1478, AG1571 (SU 5271; Sugen), temsirolimus (TORISEL®, Wyeth), pazopanib (GlaxoSmithKline), canfosfamide (TELCYTA®, Telik), thiotepa and cyclosphosphamide (CYTOXAN®, NEOSAR®); alkyl sulfonates such as busulfan, improsulfan and piposulfan; aziridines such as benzodopa, carboquone, meturedopa, and uredopa; ethylenimines and methylamelamines including altretamine, triethylenemelamine, triethylenephosphoramide, triethylenethiophosphoramide and trimethylomelamine; acetogenins (especially bullatacin and bullatacinone); a camptothecin (including the synthetic analog topotecan); bryostatin; callystatin; CC-1065 (including its adozelesin, carzelesin and bizelesin synthetic analogs); cryptophycins (particularly cryptophycin 1 and cryptophycin 8); dolastatin; duocarmycin (including the synthetic analogs, KW-2189 and CB1-TM1); eleutherobin; pancratistatin; a sarcodictyin; spongistatin; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimnustine; antibiotics such as the enediyne antibiotics (e.g. calicheamicin, calicheamicin gamma1I, calicheamicin omega1 (*Angew Chem. Intl. Ed. Engl.* (1994) 33:183-186); dynemicin, dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, morpholino-doxorubicin, cyanomorpholino-doxorubicin, 2-pyrrolino-doxorubicin and deoxydoxorubicin), epirubicin, esorubicin, idarubicin, nemorubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogs such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine;

elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; 6-thioguanine; mercaptopurine; methotrexate; platinum analogs such as cisplatin and carboplatin; vinblastine; etoposide (VP-16); ifosfamide; mitoxantrone; vincristine; vinorelbine (NAVELBINE®); novantrone; teniposide; edatrexate; daunomycin; aminopterin; capecitabine (XELODA®, Roche); ibandronate; CPT-11; topoisomerase inhibitor RFS 2000; difluoromethylornithine (DMFO); retinoids such as retinoic acid; and pharmaceutically acceptable salts, acids and derivatives of any of the above.

Also included in the definition of "chemotherapeutic agent" are: (i) anti-hormonal agents that act to regulate or inhibit hormone action on tumors such as anti-estrogens and selective estrogen receptor modulators (SERMs), including, for example, tamoxifen (including NOLVADEX®; tamoxifen citrate), raloxifene, droloxifene, 4-hydroxytamoxifen, trioxifene, keoxifene, LY117018, onapristone, and FARESTON® (toremifine citrate); (ii) aromatase inhibitors that inhibit the enzyme aromatase, which regulates estrogen production in the adrenal glands, such as, for example, 4(5)-imidazoles, aminoglutethimide, MEGASE® (megestrol acetate), AROMASIN® (exemestane; Pfizer), formestanie, fadrozole, RIVISOR® (vorozole), FEMARA® (letrozole; Novartis), and ARIMIDEX® (anastrozole; AstraZeneca); (iii) anti-androgens such as flutamide, nilutamide, bicalutamide, leuprolide, and goserelin; as well as troxacitabine (a 1,3-dioxolane nucleoside cytosine analog); (iv) protein kinase inhibitors such as MEK inhibitors (WO 2007/044515); (v) lipid kinase inhibitors; (vi) antisense oligonucleotides, particularly those which inhibit expression of genes in signaling pathways implicated in aberrant cell proliferation, for example, PKC-alpha, Raf and H-Ras, such as oblimersen (GENASENSE®, Genta Inc.); (vii) ribozymes such as VEGF expression inhibitors (e.g., ANGIOZYME®) and HER2 expression inhibitors; (viii) vaccines such as gene therapy vaccines, for example, ALLOVECTIN®, LEUVECTIN®, and VAXID®; PROLEUKIN® rIL-2; topoisomerase 1 inhibitors such as LURTOTECAN®; ABARELIX® rmRH; (ix) anti-angiogenic agents such as bevacizumab (AVASTIN®, Genentech); and pharmaceutically acceptable salts, acids and derivatives of any of the above.

Also included in the definition of "chemotherapeutic agent" are therapeutic antibodies such as alemtuzumab (Campath), bevacizumab (AVASTIN®, Genentech); cetuximab (ERBITUX®, Imclone); panitumumab (VECTIBIX®, Amgen), rituximab (RITUXAN®, Genentech/Biogen Idec), pertuzumab (OMNITARG™, 2C4, Genentech), trastuzumab (HERCEPTIN®, Genentech), tositumomab (Bexxar, Corixia), and the antibody drug conjugate, gemtuzumab ozogamicin (MYLOTARG®, Wyeth).

Humanized monoclonal antibodies with therapeutic potential as chemotherapeutic agents in combination with the conjugates of the invention include: alemtuzumab, apolizumab, aselizumab, atlizumab, bapineuzumab, bevacizumab, bivatuzumab mertansine, cantuzumab mertansine, cedelizumab, certolizumab pegol, cidfusituzumab, cidtuzumab, daclizumab, eculizumab, efalizumab, epratuzumab, erlizumab, felvizumab, fontolizumab, gemtuzumab ozogamicin, inotuzumab ozogamicin, ipilimumab, labetuzumab, lintuzumab, matuzumab, mepolizumab, motavizumab, motovizumab, natalizumab, nimotuzumab, nolovizumab, numavizumab, ocrelizumab, omalizumab, palivizumab, pascolizumab, pecfusituzumab, pectuzumab, pertuzumab, pexelizumab, ralivizumab, ranibizumab, reslivizumab, reslizumab, resyvizumab, rovelizumab, ruplizumab, sibrotuzumab, siplizumab, sontuzumab, tacatuzumab tetraxetan, tadocizumab, talizumab, tefibazumab, tocilizumab, toralizumab, trastuzumab, tucotuzumab celmoleukin, tucusituzumab, umavizumab, urtoxazumab, and visilizumab.

Pharmaceutical compositions according to the present invention, and for use in accordance with the present invention, may comprise, in addition to the active ingredient, i.e. a conjugate compound, a pharmaceutically acceptable excipient, carrier, buffer, stabiliser or other materials well known to those skilled in the art. Such materials should be non-toxic and should not interfere with the efficacy of the active ingredient. The precise nature of the carrier or other material will depend on the route of administration, which may be oral, or by injection, e.g. cutaneous, subcutaneous, or intravenous.

Pharmaceutical compositions for oral administration may be in tablet, capsule, powder or liquid form. A tablet may comprise a solid carrier or an adjuvant. Liquid pharmaceutical compositions generally comprise a liquid carrier such as water, petroleum, animal or vegetable oils, mineral oil or synthetic oil. Physiological saline solution, dextrose or other saccharide solution or glycols such as ethylene glycol, propylene glycol or polyethylene glycol may be included. A capsule may comprise a solid carrier such a gelatin.

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives may be included, as required.

Formulations

While it is possible for the conjugate compound to be used (e.g., administered) alone, it is often preferable to present it as a composition or formulation.

In one embodiment, the composition is a pharmaceutical composition (e.g., formulation, preparation, medicament) comprising a conjugate compound, as described herein, and a pharmaceutically acceptable carrier, diluent, or excipient.

In one embodiment, the composition is a pharmaceutical composition comprising at least one conjugate compound, as described herein, together with one or more other pharmaceutically acceptable ingredients well known to those skilled in the art, including, but not limited to, pharmaceutically acceptable carriers, diluents, excipients, adjuvants, fillers, buffers, preservatives, anti-oxidants, lubricants, stabilisers, solubilisers, surfactants (e.g., wetting agents), masking agents, colouring agents, flavouring agents, and sweetening agents.

In one embodiment, the composition further comprises other active agents, for example, other therapeutic or prophylactic agents.

Suitable carriers, diluents, excipients, etc. can be found in standard pharmaceutical texts. See, for example, *Handbook of Pharmaceutical Additives,* 2nd Edition (eds. M. Ash and I. Ash), 2001 (Synapse Information Resources, Inc., Endicott, N.Y., USA), *Remington's Pharmaceutical Sciences,* 20th edition, pub. Lippincott, Williams & Wilkins, 2000; and *Handbook of Pharmaceutical Excipients,* 2nd edition, 1994.

Another aspect of the present invention pertains to methods of making a pharmaceutical composition comprising admixing at least one [$^{11}$C]-radiolabelled conjugate or conjugate-like compound, as defined herein, together with one or more other pharmaceutically acceptable ingredients well known to those skilled in the art, e.g., carriers, diluents, excipients, etc. If formulated as discrete units (e.g., tablets, etc.), each unit contains a predetermined amount (dosage) of the active compound.

The term "pharmaceutically acceptable," as used herein, pertains to compounds, ingredients, materials, compositions, dosage forms, etc., which are, within the scope of sound medical judgment, suitable for use in contact with the tissues of the subject in question (e.g., human) without excessive toxicity, irritation, allergic response, or other problem or complication, commensurate with a reasonable benefit/risk ratio. Each carrier, diluent, excipient, etc. must also be "acceptable" in the sense of being compatible with the other ingredients of the formulation.

The formulations may be prepared by any methods well known in the art of pharmacy. Such methods include the step of bringing into association the active compound with a carrier which constitutes one or more accessory ingredients. In general, the formulations are prepared by uniformly and intimately bringing into association the active compound with carriers (e.g., liquid carriers, finely divided solid carrier, etc.), and then shaping the product, if necessary.

The formulation may be prepared to provide for rapid or slow release; immediate, delayed, timed, or sustained release; or a combination thereof.

Formulations suitable for parenteral administration (e.g., by injection), include aqueous or non-aqueous, isotonic, pyrogen-free, sterile liquids (e.g., solutions, suspensions), in which the active ingredient is dissolved, suspended, or otherwise provided (e.g., in a liposome or other microparticulate). Such liquids may additional contain other pharmaceutically acceptable ingredients, such as anti-oxidants, buffers, preservatives, stabilisers, bacteriostats, suspending agents, thickening agents, and solutes which render the formulation isotonic with the blood (or other relevant bodily fluid) of the intended recipient. Examples of excipients include, for example, water, alcohols, polyols, glycerol, vegetable oils, and the like. Examples of suitable isotonic carriers for use in such formulations include Sodium Chloride Injection, Ringer's Solution, or Lactated Ringer's Injection. Typically, the concentration of the active ingredient in the liquid is from about 1 ng/ml to about 10 µg/ml, for example from about 10 ng/ml to about 1 µg/ml. The formulations may be presented in unit-dose or multi-dose sealed containers, for example, ampoules and vials, and may be stored in a freeze-dried (lyophilised) condition requiring only the addition of the sterile liquid carrier, for example water for injections, immediately prior to use. Extemporaneous injection solutions and suspensions may be prepared from sterile powders, granules, and tablets.

Dosage

It will be appreciated by one of skill in the art that appropriate dosages of the conjugate compound, and compositions comprising the conjugate compound, can vary from patient to patient. Determining the optimal dosage will generally involve the balancing of the level of therapeutic benefit against any risk or deleterious side effects. The selected dosage level will depend on a variety of factors including, but not limited to, the activity of the particular compound, the route of administration, the time of administration, the rate of excretion of the compound, the duration of the treatment, other drugs, compounds, and/or materials used in combination, the severity of the condition, and the species, sex, age, weight, condition, general health, and prior medical history of the patient. The amount of compound and route of administration will ultimately be at the discretion of the physician, veterinarian, or clinician, although generally the dosage will be selected to achieve local concentrations at the site of action which achieve the desired effect without causing substantial harmful or deleterious side-effects.

Administration can be effected in one dose, continuously or intermittently (e.g., in divided doses at appropriate intervals) throughout the course of treatment. Methods of determining the most effective means and dosage of administration are well known to those of skill in the art and will vary with the formulation used for therapy, the purpose of the therapy, the target cell(s) being treated, and the subject being treated. Single or multiple administrations can be carried out with the dose level and pattern being selected by the treating physician, veterinarian, or clinician.

In general, a suitable dose of the active compound is in the range of about 100 ng to about 25 mg (more typically about 1 µg to about 10 mg) per kilogram body weight of the subject per day. Where the active compound is a salt, an ester, an amide, a prodrug, or the like, the amount administered is calculated on the basis of the parent compound and so the actual weight to be used is increased proportionately.

In one embodiment, the active compound is administered to a human patient according to the following dosage regime: about 100 mg, 3 times daily.

In one embodiment, the active compound is administered to a human patient according to the following dosage regime: about 150 mg, 2 times daily.

In one embodiment, the active compound is administered to a human patient according to the following dosage regime: about 200 mg, 2 times daily.

However in one embodiment, the conjugate compound is administered to a human patient according to the following dosage regime: about 50 or about 75 mg, 3 or 4 times daily.

In one embodiment, the conjugate compound is administered to a human patient according to the following dosage regime: about 100 or about 125 mg, 2 times daily.

The dosage amounts described above may apply to the conjugate (including the PBD moiety and the linker to the antibody) or to the effective amount of PBD compound provided, for example the amount of compound that is releasable after cleavage of the linker.

For the prevention or treatment of disease, the appropriate dosage of an ADC of the invention will depend on the type of disease to be treated, as defined above, the severity and course of the disease, whether the molecule is administered for preventive or therapeutic purposes, previous therapy, the patient's clinical history and response to the antibody, and the discretion of the attending physician. The molecule is suitably administered to the patient at one time or over a series of treatments. Depending on the type and severity of the disease, about 1 µg/kg to 15 mg/kg (e.g. 0.1-20 mg/kg) of molecule is an initial candidate dosage for administration to the patient, whether, for example, by one or more separate administrations, or by continuous infusion. A typical daily dosage might range from about 1 µg/kg to 100 mg/kg or more, depending on the factors mentioned above. An exemplary dosage of ADC to be administered to a patient is in the range of about 0.1 to about 10 mg/kg of patient weight. For repeated administrations over several days or longer, depending on the condition, the treatment is sustained until a desired suppression of disease symptoms occurs. An exemplary dosing regimen comprises a course of administering an initial loading dose of about 4 mg/kg, followed by additional doses every week, two weeks, or three weeks of an ADC. Other dosage regimens may be useful. The progress of this therapy is easily monitored by conventional techniques and assays.

Treatment

The term "treatment," as used herein in the context of treating a condition, pertains generally to treatment and therapy, whether of a human or an animal (e.g., in veterinary applications), in which some desired therapeutic effect is achieved, for example, the inhibition of the progress of the condition, and includes a reduction in the rate of progress, a halt in the rate of progress, regression of the condition, amelioration of the condition, and cure of the condition. Treatment as a prophylactic measure (i.e., prophylaxis, prevention) is also included.

The term "therapeutically-effective amount," as used herein, pertains to that amount of an active compound, or a material, composition or dosage from comprising an active compound, which is effective for producing some desired therapeutic effect, commensurate with a reasonable benefit/risk ratio, when administered in accordance with a desired treatment regimen.

Similarly, the term "prophylactically-effective amount," as used herein, pertains to that amount of an active compound, or a material, composition or dosage from comprising an active compound, which is effective for producing some desired prophylactic effect, commensurate with a reasonable benefit/risk ratio, when administered in accordance with a desired treatment regimen.

The Subject/Patient

The subject/patient may be an animal, mammal, a placental mammal, a marsupial (e.g., kangaroo, wombat), a monotreme (e.g., duckbilled platypus), a rodent (e.g., a guinea pig, a hamster, a rat, a mouse), murine (e.g., a mouse), a lagomorph (e.g., a rabbit), avian (e.g., a bird), canine (e.g., a dog), feline (e.g., a cat), equine (e.g., a horse), porcine (e.g., a pig), ovine (e.g., a sheep), bovine (e.g., a cow), a primate, simian (e.g., a monkey or ape), a monkey (e.g., marmoset, baboon), an ape (e.g., gorilla, chimpanzee, orangutang, gibbon), or a human.

Furthermore, the subject/patient may be any of its forms of development, for example, a foetus. In one preferred embodiment, the subject/patient is a human.

In one embodiment, the patient is a population where each patient has a tumour having $\alpha_v\beta_6$ integrin on the surface of the cell.

Includes Other Forms

Unless otherwise specified, included in the above are the well known ionic, salt, solvate, and protected forms of these substituents. For example, a reference to carboxylic acid (—COOH) also includes the anionic (carboxylate) form (—COO$^-$), a salt or solvate thereof, as well as conventional protected forms. Similarly, a reference to an amino group includes the protonated form (—N$^+$HR$^1$R$^2$), a salt or solvate of the amino group, for example, a hydrochloride salt, as well as conventional protected forms of an amino group. Similarly, a reference to a hydroxyl group also includes the anionic form (—O$^-$), a salt or solvate thereof, as well as conventional protected forms.

Salts

It may be convenient or desirable to prepare, purify, and/or handle a corresponding salt of the active compound, for example, a pharmaceutically-acceptable salt. Examples of pharmaceutically acceptable salts are discussed in Berge, et al., *J. Pharm. Sci.*, 66, 1-19 (1977).

For example, if the compound is anionic, or has a functional group which may be anionic (e.g. —COOH may be —COO$^-$), then a salt may be formed with a suitable cation. Examples of suitable inorganic cations include, but are not limited to, alkali metal ions such as Na$^+$ and K$^+$, alkaline earth cations such as Ca$^{2+}$ and Mg$^{2+}$, and other cations such as Al$^{+3}$. Examples of suitable organic cations include, but are not limited to, ammonium ion (i.e. NH$_4^+$) and substituted ammonium ions (e.g. NH$_3$R$^+$, NH$_2$R$_2^+$, NHR$_3^+$, NR$_4^+$). Examples of some suitable substituted ammonium ions are those derived from: ethylamine, diethylamine, dicyclohexylamine, triethylamine, butylamine, ethylenediamine, ethanolamine, diethanolamine, piperazine, benzylamine, phenylbenzylamine, choline, meglumine, and tromethamine, as well as amino acids, such as lysine and arginine. An example of a common quaternary ammonium ion is N(CH$_3$)$_4^+$.

If the compound is cationic, or has a functional group which may be cationic (e.g. —NH$_2$ may be —NH$_3^+$), then a salt may be formed with a suitable anion. Examples of suitable inorganic anions include, but are not limited to, those derived from the following inorganic acids: hydrochloric, hydrobromic, hydroiodic, sulfuric, sulfurous, nitric, nitrous, phosphoric, and phosphorous.

Examples of suitable organic anions include, but are not limited to, those derived from the following organic acids: 2-acetyoxybenzoic, acetic, ascorbic, aspartic, benzoic, camphorsulfonic, cinnamic, citric, edetic, ethanedisulfonic, ethanesulfonic, fumaric, glucheptonic, gluconic, glutamic, glycolic, hydroxymaleic, hydroxynaphthalene carboxylic, isethionic, lactic, lactobionic, lauric, maleic, malic, methanesulfonic, mucic, oleic, oxalic, palmitic, pamoic, pantothenic, phenylacetic, phenylsulfonic, propionic, pyruvic, salicylic, stearic, succinic, sulfanilic, tartaric, toluenesulfonic, and valeric. Examples of suitable polymeric organic anions include, but are not limited to, those derived from the following polymeric acids: tannic acid, carboxymethyl cellulose.

Solvates

It may be convenient or desirable to prepare, purify, and/or handle a corresponding solvate of the active compound. The term "solvate" is used herein in the conventional sense to refer to a complex of solute (e.g. active compound, salt of active compound) and solvent. If the solvent is water, the solvate may be conveniently referred to as a hydrate, for example, a mono-hydrate, a di-hydrate, a tri-hydrate, etc.

Carbinolamines

The invention includes compounds where a solvent adds across the imine bond of the PBD moiety, which is illustrated below where the solvent is water or an alcohol (R$^A$OH, where R$^A$ is C$_{1-4}$ alkyl):

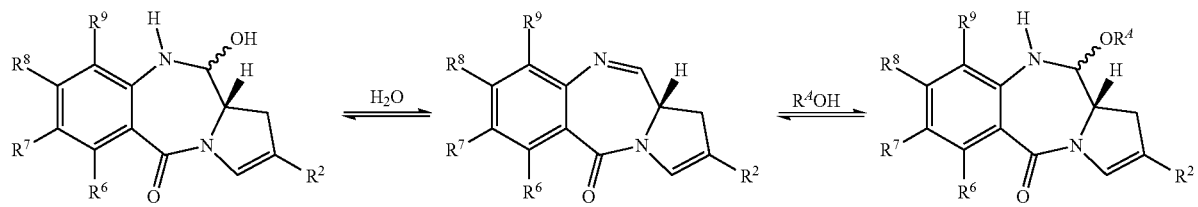

These forms can be called the carbinolamine and carbinolamine ether forms of the PBD. The balance of these equilibria depend on the conditions in which the compounds are found, as well as the nature of the moiety itself.

These particular compounds may be isolated in solid form, for example, by lyophilisation.

Isomers

Certain compounds may exist in one or more particular geometric, optical, enantiomeric, diasteriomeric, epimeric, atropic, stereoisomeric, tautomeric, conformational, or anomeric forms, including but not limited to, cis- and trans-forms; E- and Z-forms; c-, t-, and r-forms; endo- and exo-forms; R-, S-, and meso-forms; D- and L-forms; d- and l-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and halfchair-forms; and combinations thereof, hereinafter collectively referred to as "isomers" (or "isomeric forms").

Note that, except as discussed below for tautomeric forms, specifically excluded from the term "isomers", as used herein, are structural (or constitutional) isomers (i.e. isomers which differ in the connections between atoms rather than merely by the position of atoms in space). For example, a reference to a methoxy group, —OCH$_3$, is not to be construed as a reference to its structural isomer, a hydroxymethyl group, —CH$_2$OH. Similarly, a reference to ortho-chlorophenyl is not to be construed as a reference to its structural isomer, meta-chlorophenyl. However, a reference to a class of structures may well include structurally isomeric forms falling within that class (e.g. C$_{1-7}$ alkyl includes n-propyl and iso-propyl; butyl includes n-, iso-, sec-, and tert-butyl; methoxyphenyl includes ortho-, meta-, and para-methoxyphenyl).

The above exclusion does not pertain to tautomeric forms, for example, keto-, enol-, and enolate-forms, as in, for example, the following tautomeric pairs: keto/enol (illustrated below), imine/enamine, amide/imino alcohol, amidine/amidine, nitroso/oxime, thioketone/enethiol, N-nitroso/hyroxyazo, and nitro/aci-nitro.

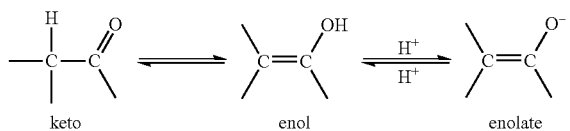

Note that specifically included in the term "isomer" are compounds with one or more isotopic substitutions. For example, H may be in any isotopic form, including $^1$H, $^2$H (D), and $^3$H (T); C may be in any isotopic form, including $^{12}$C, $^{13}$C, $^{13}$C, and $^{14}$C; O may be in any isotopic form, including $^{16}$O and $^{18}$O; and the like.

Unless otherwise specified, a reference to a particular compound includes all such isomeric forms, including (wholly or partially) racemic and other mixtures thereof. Methods for the preparation (e.g. asymmetric synthesis) and separation (e.g. fractional crystallisation and chromatographic means) of such isomeric forms are either known in the art or are readily obtained by adapting the methods taught herein, or known methods, in a known manner.

General Synthetic Routes

The synthesis of PBD compounds containing two imine moieties is extensively discussed in the following references, which discussions are incorporated herein by reference:

a) WO 00/12508 (pages 14 to 30);
b) WO 2005/023814 (pages 3 to 10);
c) WO 2004/043963 (pages 28 to 29);
d) WO 2005/085251 (pages 30 to 39);
e) WO 2010/043880 (pages 26 to 29);
f) WO 2011/130613 (pages 56 to 59); and
g) WO 2011/130616 (pages 57 to 61).

Synthesis Route

The compounds of formula I, where either R$^{10}$ and R$^{11b}$ or R$^{20}$ and R$^{21b}$ form a nitrogen-carbon double bond between the nitrogen and carbon atoms to which they are bound, can be synthesised from a compound of Formula 2:

Formula 2

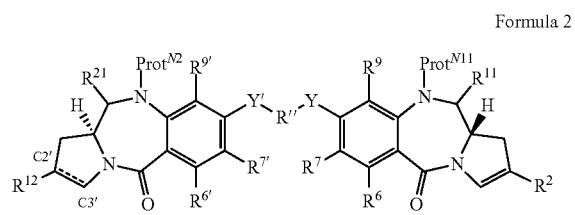

where R$^2$, R$^6$, R$^7$, R$^9$, R$^{6'}$, R$^{7'}$, R$^{9'}$, R$^{12}$, X, X' and R" are as defined for compounds of formula I, one of the pairs of R$^{11}$ and Prot$^{N1}$ and R$^{21}$ and Prot$^{N2}$ are OProt$^O$ and a carbamate nitrogen protecting group for synthesis and the other pair is selected from:

(a) =O and a hemi-aminal nitrogen protecting group for synthesis;

(b) H and a carbamate nitrogen protecting group for synthesis, by applying the necessary conditions to remove the protecting groups.

The compound of formula 2 may be used directly to make drug-linkers, and conjugates of the present invention, and thus may be a further aspect of the present invention. Part of the linking group may be added (for example, to form a protected compound of formula III), following which the deprotection discussed above can be carried out.

The group X or Q (part of R$^2$) in Formula 2 may be protected during the synthetic steps described below, in which case, it can be removed to give the desired compound of Formula 2.

The compound of Formula 2 can be synthesised by the coupling of compounds of Formulae 3a and 4a, or compounds of Formulae 3b and 4b:

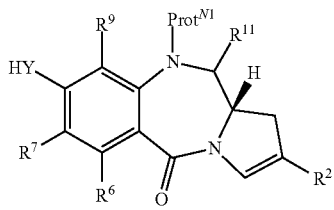

Formula 3a

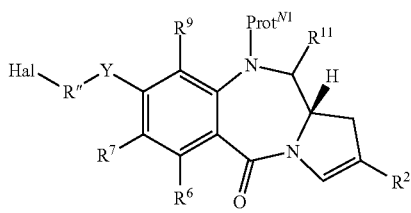

Formula 3b

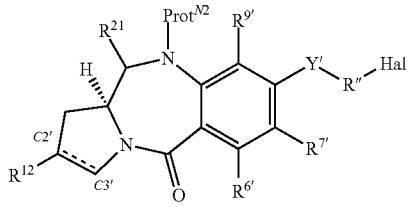

Formula 4a

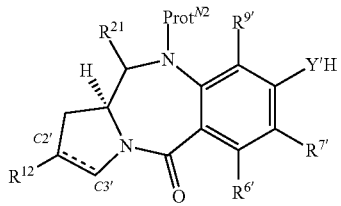

Formula 4b where Hal is selected from I, Cl, and Br.

The coupling can be achieved, for example, in refluxing acetone with a base, such as $K_2CO_3$.

The compounds of Formulae 3b and 4a may be synthesised by reacting compounds of Formulae 3a and 4b respectively with a compound of Formula 5:

Hal-R''-Q    Formula 5 where Q is selected from I, Cl, and Br, The reaction can be achieved, for example, in refluxing acetone with a base, such as $K_2CO_3$. An excess of the compound of Formula 5 is required to achieve the desired product.

The monomer which contains the imine or equivalent group can be synthesised in a similar manner to that described in co-pending PCT application PCT/EP2012/070232, filed 12 Oct. 2012, which is incorporated herein by reference. This approach is described below in relation to the compound of Formula 3a where $R^{11}$ and $Prot^{N1}$ are $OProt^O$ and a carbamate nitrogen protecting group for synthesis (Formula 3a-1), but is equally applicable to the compound of Formula 4b, where $R^{21}$ and $Prot^{N2}$ are $OProt^O$ and a carbamate nitrogen protecting group for synthesis.

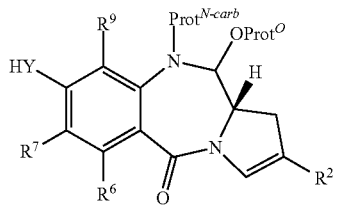

Formula 3a-I $Prot^{N-carb}$ represents a carbamate nitrogen protecting group for synthesis.

The compound of Formula 3a-I may be synthesised from a compound of Formula 6-I:

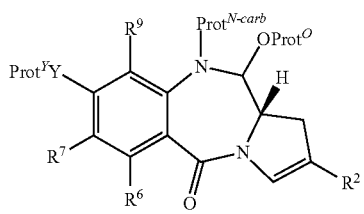

Formula 6-I where $Prot^Y$ is a protecting group for Y that is orthogonal to the other protecting groups in the compound. The synthesis is achieved by deprotection of Y, under standard conditions.

The compound of Formula 6-I may be synthesised from a compound of Formula 7-I:

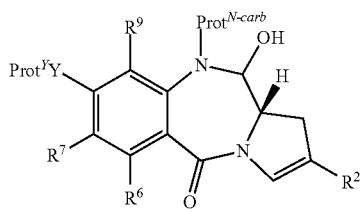

Formula 7-I by protecting the OH group with $Prot^O$, under non-racemizing conditions.

The compound of Formula 7-I may be synthesised from a compound of Formula 8-I:

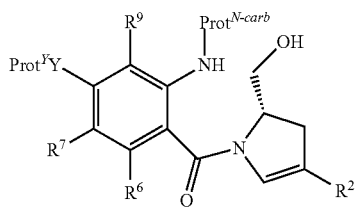

Formula 8-I by oxidation. The oxidation may be carried out, for example, with Dess-Martin periodinane (or alternatively TPAP/NMO, TFAA/DMSO, $SO_3$. Pyridine complex/DMSO, PDC, PCC, BAIB/TEMPO or under Swern conditions).

The compound of Formula 8-I may be synthesised from a compound of Formula 9-I:

Formula 9-I

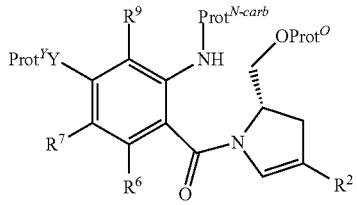

by deprotection of the OH group under standard conditions.

The compound of Formula 9-I may be synthesised from a compound of Formula 10-I:

Formula 10-I

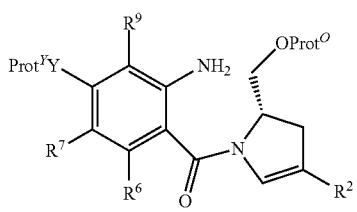

by protection of the amine group by $Prot^{N\text{-}carb}$ under standard conditions.

The compound of Formula 10-I may be synthesised from a compound of Formula 11-I:

Formula 11-I

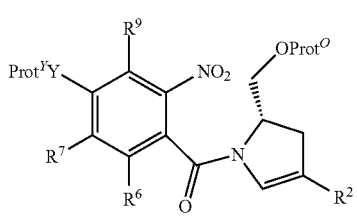

by reduction of the nitro group. The reduction can be achieved by standard means, for example with Zn dust with 5% formic acid in methanol.

The compound of Formula 11-I may be synthesised from a compound of Formula 12-I:

Formula 12-I

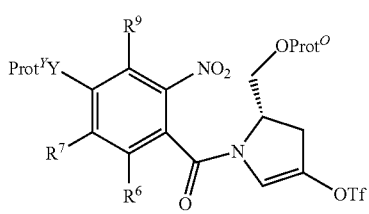

by the palladium mediated coupling of the appropriate compound comprising —$R^2$. This coupling includes, but is not limited to: Suzuki couplings with an appropriate boron derivative; Heck coupling with alkenes, including acrylamides and acrylates; Stille couplings with organo tin reagents, such as alkyl tin reagents; Sonagishira couplings with alkynes; and hydride transfer using triethyl silanes.

The compound of Formula 12-I may be synthesised from a compound of Formula 13-I:

Formula 13-I

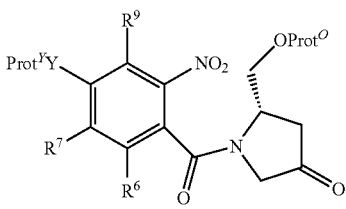

by triflation using triflic anhydride and anhydrous 2,6-lutidine or anhydrous 2,6-$^t$Bu-pyridine at a temperature of −35° C. or lower in a dry organic solvent under an inert atmosphere.

In the synthesis of compounds of Formula 4b where there is not a double bond between C2' and C3', the relevant $R^{12}$ may be introduced at this stage.

If the other monomer contains an amine group, it can be synthesised in a similar manner to that described above. This approach is described below in relation to the compound of Formula 3a where $R^{11}$ and $Prot^{N1}$ are H and a carbamate nitrogen protecting group for synthesis (Formula 3a-II), but is equally applicable to the compound of Formula 4b, where $R^{21}$ and $Prot^{N2}$ are H and a carbamate nitrogen protecting group for synthesis.

Formula 3a-II

The compound of Formula 3a-II may be synthesised from a compound of Formula 6-II:

Formula 6-II where $Prot^Y$ is a protecting group for Y that is orthogonal to the other protecting groups in the compound. The synthesis is achieved by deprotection of Y, under standard conditions.

The compound of Formula 6-II may be synthesised from a compound of Formula 7-II:

Formula 7-II by protecting the NH group with Prot$^{N\text{-}carb}$, under standard conditions.

The compound of Formula 7-II may be synthesised from a compound of Formula 8-II:

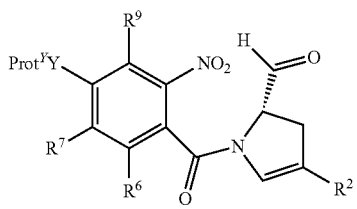

Formula 8-II by reductive amination.

The compound of Formula 8-II may be synthesised from a compound of Formula 9-II:

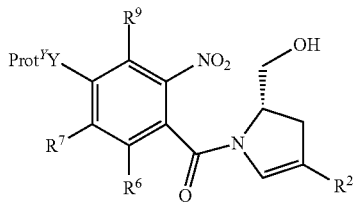

Formula 9-II by oxidation of the alcohol.

The compound of Formula 9-II may be synthesised from a compound of Formula 11-I:

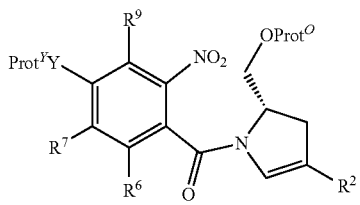

Formula 11-I by deprotection of the OH group under standard conditions.

The compound of Formula 6-II may alternatively be synthesised from a compound of formula 12:

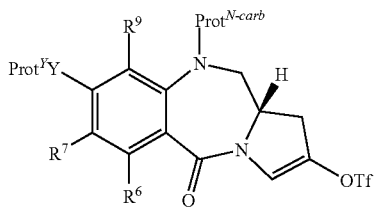

Formula 12 by the palladium mediated coupling of the appropriate compound comprising —R$^2$ (as described above).

The compound of formula 12 may be synthesised from a compound of formula 13:

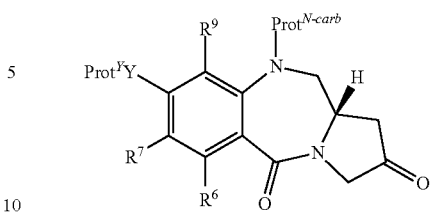

Formula 13 by triflation. This may be carried out with the conditions described above, or with standard conditions.

The compound of formula 13 may be synthesised from a compound of formula 14:

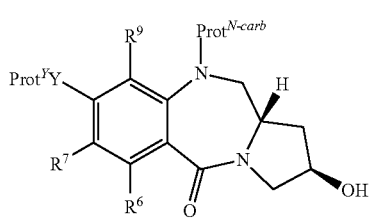

Formula 14 by oxidation of the alcohol group using standard conditions.

The compound of formula 14 may be synthesised from a compound of formula 15:

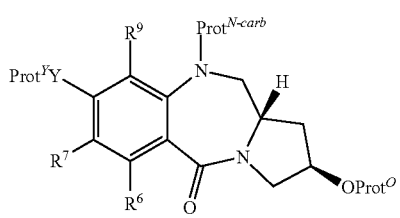

Formula 15 by removal of the Prot$^O$ group, which group is a alcohol protecting group orthogonal to the other protecting groups in the compound.

The compound of formula 15 may be synthesised from a compound of formula 16:

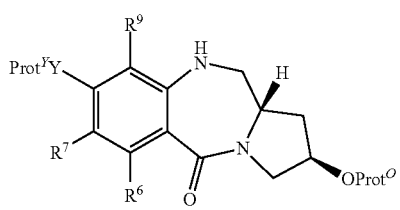

Formula 16 by protection of the amine with a carbamate nitrogen protecting group.

The compound of formula 16 may be synthesised from a compound of formula 17:

Formula 17

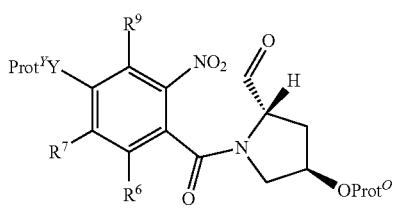

by reductive amination.

The compound of formula 17 may be synthesised from a compound of formula 18:

Formula 18

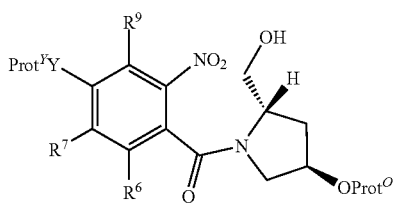

by oxidation of the unprotected alcohol group. The compound of formula 18 can be used to synthesise the compound of Formula 13-I.

The compound of formula 18 may be synthesised from a compound of formula 19:

Formula 19

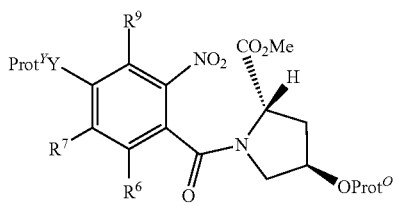

by reduction of the ester functionality.

The compound of formula 19 may be synthesised from by coupling compounds of formulae 20 and 21:

Formula 20

Formula 21

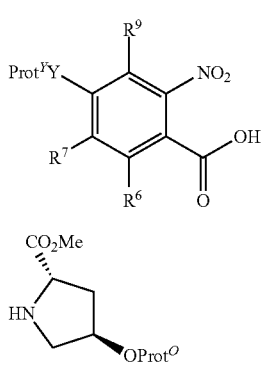

under amide coupling conditions.

If the other monomer contains an amide group, it can be synthesised in a similar manner to that described above. This approach is described below in relation to the compound of Formula 3a where $R^{11}$ and $Prot^{N1}$ are =O and a hemi-aminal nitrogen protecting group for synthesis (Formula 3a-III), but is equally applicable to the compound of Formula 4b, where $R^{21}$ and $Prot^{N2}$ are =O and a hemi-aminal nitrogen protecting group for synthesis.

Formula 3a-III

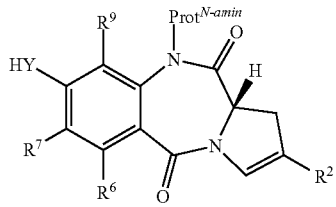

where $Prot^{N-amin}$ represents a hemi-aminal nitrogen protecting group for synthesis.

The compound of Formula 3a-III may be synthesised from a compound of Formula 22:

Formula 22

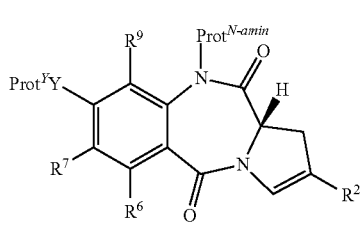

by deprotection of Y, under standard conditions.

The compound of Formula 22 may be synthesised from a compound of Formula 23:

Formula 23

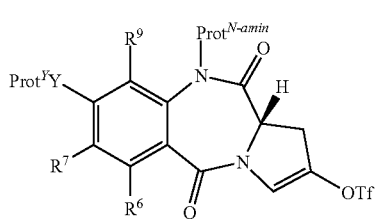

by the palladium mediated coupling of the appropriate compound comprising —$R^2$ (as described above).

The compound of Formula 23 may be synthesised from a compound of Formula 24:

Formula 24

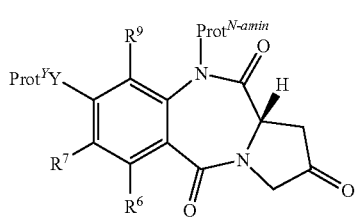

by triflation. This may be carried out with the conditions described above, or with standard conditions.

The compound of Formula 24 may be synthesised from a compound of Formula 25:

Formula 25

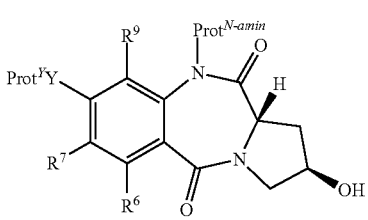

by oxidation of the alcohol group.

The compound of Formula 25 may be synthesised from a compound of Formula 26:

Formula 26

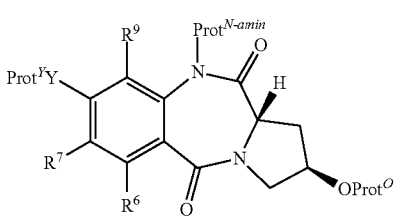

by removal of the $Prot^O$ group, which group is a alcohol protecting group orthogonal to the other protecting groups in the compound.

The compound of Formula 26 may be synthesised from a compound of Formula 27:

Formula 27

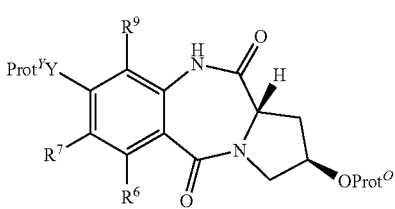

by protection of the amine with an hemi-aminal nitrogen protecting group.

The compound of Formula 27 may be synthesised from a compound of Formula 19 by reduction of the ester functionality by hydrogen and Pd/C to achieve ring closure.

An alternative synthesis strategy is illustrated in Example 1 below.

Nitrogen Protecting Groups for Synthesis

Nitrogen protecting groups for synthesis are well known in the art. In the present invention, the protecting groups of particular interest are carbamate nitrogen protecting groups and hemi-aminal nitrogen protecting groups.

Carbamate nitrogen protecting groups have the following structure:

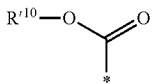

wherein $R'^{10}$ is R as defined above. A large number of suitable groups are described on pages 503 to 549 of Greene, T. W. and Wuts, G. M., Protective Groups in Organic Synthesis, 3$^{rd}$ Edition, John Wiley & Sons, Inc., 1999, which is incorporated herein by reference.

Particularly preferred protecting groups include Troc, Teoc, Fmoc, BOC, Doc, Hoc, TcBOC, 1-Adoc and 2-Adoc.

Other possible groups are nitrobenzyloxycarbonyl (e.g. 4-nitrobenzyloxycarbonyl) and 2-(phenylsulphonyl)ethoxycarbonyl.

Those protecting groups which can be removed with palladium catalysis are not preferred, e.g. Alloc.

Hemi-aminal nitrogen protecting groups have the following structure:

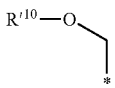

wherein $R'^{10}$ is R as defined above. A large number of suitable groups are described on pages 633 to 647 as amide protecting groups of Greene, T. W. and Wuts, G. M., Protective Groups in Organic Synthesis, 3$^{rd}$ Edition, John Wiley & Sons, Inc., 1999, which is incorporated herein by reference. The groups disclosed herein can be applied to compounds of the present invention. Such groups include, but are not limited to, SEM, MOM, MTM, MEM, BOM, nitro or methoxy substituted BOM, $Cl_3CCH_2OCH_2$—.

Protected Oxygen Group for Synthesis

Protected oxygen group for synthesis are well known in the art. A large number of suitable oxygen protecting groups are described on pages 23 to 200 of Greene, T. W. and Wuts, G. M., Protective Groups in Organic Synthesis, 3$^{rd}$ Edition, John Wiley & Sons, Inc., 1999, which is incorporated herein by reference.

Classes of particular interest include silyl ethers, methyl ethers, alkyl ethers, benzyl ethers, esters, acetates, benzoates, carbonates, and sulfonates.

Preferred oxygen protecting groups include acetates, TBS and THP.

Synthesis of Drug Conjugates

Conjugates can be prepared as previously described. Linkers having a maleimidyl group (A), a peptide group ($L^1$) and self-immolative group ($L^2$) can be prepared as described in U.S. Pat. No. 6,214,345, which is incorporated herein by reference. Linkers having a maleimidyl group (A) and a peptide group ($L^1$) can be prepared as described in WO 2009/0117531, which is incorporated herein by reference. Other linkers can be prepared according to the references cited herein or as known to the skilled artisan.

Linker-Drug compounds can be prepared according to methods known in the art. Linkage of amine-based X substituents (of the PDB dimer Drug unit) to active groups of the Linker units can be performed according to methods generally described in U.S. Pat. Nos. 6,214,345 and 7,498, 298; and WO 2009-0117531, or as otherwise known to the skilled artisan.

Antibodies can be conjugated to Linker-Drug compounds as described in Doronina et al., Nature Biotechnology, 2003, 21, 778-784). Briefly, antibodies (4-5 mg/mL) in PBS containing 50 mM sodium borate at pH 7.4 are reduced with tris(carboxyethyl)phosphine hydrochloride (TCEP) at 37° C. The progress of the reaction, which reduces interchain disulfides, is monitored by reaction with 5,5'-dithiobis(2-nitrobenzoic acid) and allowed to proceed until the desired level of thiols/mAb is achieved. The reduced antibody is then cooled to 0° C. and alkylated with 1.5 equivalents of maleimide drug-linker per antibody thiol.

After 1 hour, the reaction is quenched by the addition of 5 equivalents of N-acetyl cysteine. Quenched drug-linker is removed by gel filtration over a PD-10 column. The ADC is then sterile-filtered through a 0.22 μm syringe filter. Protein concentration can be determined by spectral analysis at 280 nm and 329 nm, respectively, with correction for the contribution of drug absorbance at 280 nm. Size exclusion chromatography can be used to determine the extent of antibody aggregation, and RP-HPLC can be used to determine the levels of remaining NAC-quenched drug-linker.

Antibodies with introduced cysteine residues can be conjugated to Linker-Drug compounds as described in International Patent Publication WO2008/070593, which is incorporated herein or as follows. Antibodies containing an introduced cysteine residue in the heavy chain are fully reduced by adding 10 equivalents of TCEP and 1 mM EDTA and adjusting the pH to 7.4 with 1M Tris buffer (pH 9.0). Following a 1 hour incubation at 37° C., the reaction is cooled to 22° C. and 30 equivalents of dehydroascorbic acid is added to selectively reoxidize the native disulfides, while leaving the introduced cysteine in the reduced state. The pH is adjusted to 6.5 with 1M Tris buffer (pH 3.7) and the reaction is allowed to proceed for 1 hour at 22° C. The pH of the solution is then raised again to 7.4 by addition of 1 M Tris buffer (pH 9.0). 3.5 equivalents of the PBD drug linker in DMSO is placed in a suitable container for dilution with propylene glycol prior to addition to the reaction. To maintain solubility of the PBD drug linker, the antibody itself is first diluted with propylene glycol to a final concentration of 33% (e.g., if the antibody solution was in a 60 mL reaction volume, 30 mL of propylene glycol was added). This same volume of propylene glycol (30 mL in this example) is added to the PBD drug linker as a diluent. After mixing, the solution of PBD drug linker in propylene glycol is added to the antibody solution to effect the conjugation; the final concentration of propylene glycol is 50%. The reaction is allowed to proceed for 30 minutes and then quenched by addition of 5 equivalents of N-acetyl cysteine. The ADC is purified by ultrafiltration through a 30 kD membrane. (Note that the concentration of propylene glycol used in the reaction can be reduced for any particular PBD, as its sole purpose is to maintain solubility of the drug linker in the aqueous media.)

For halo-acetamide-based Linker-Drug compounds, conjugation can be performed generally as follows. To a solution of reduced and reoxidized antibodies (having introduced cysteines in the heavy chain) in 10 mM Tris (pH 7.4), 50 mM NaCl, and 2 mM DTPA is added 0.5 volumes of propylene glycol. A 10 mM solution of acetamide-based Linker-Drug compound in dimethylacetamide is prepared immediately prior to conjugation. An equivalent amount of propylene glycol as added to the antibody solution is added to a 6-fold molar excess of the Linker-Drug compound. The dilute Linker-Drug solution is added to the antibody solution and the pH is adjusted to 8-8.5 using 1 M Tris (pH 9). The conjugation reaction is allowed to proceed for 45 minutes at 37° C. The conjugation is verified by reducing and denaturing reversed phase PLRP-S chromatography. Excess Linker-Drug compound is removed with Quadrasil MP resin and the buffer is exchanged into 10 mM Tris (pH 7.4), 50 mM NaCl, and 5% propylene glycol using a PD-10 desalting column.

Illustrative Synthesis Schemes for Drug Linkers

The following schemes are illustrative of routes for synthesising drug linkers, wherein PBD represents a compound of formula I of the present invention where X is $NH_2$, which may be varied within the scope of the present invention.

Scheme A

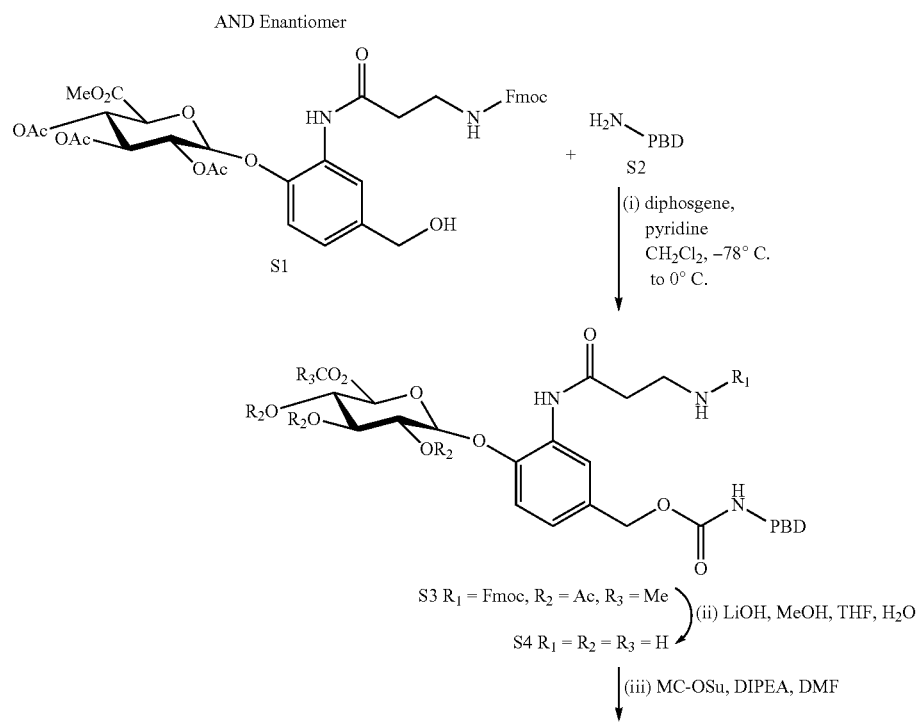

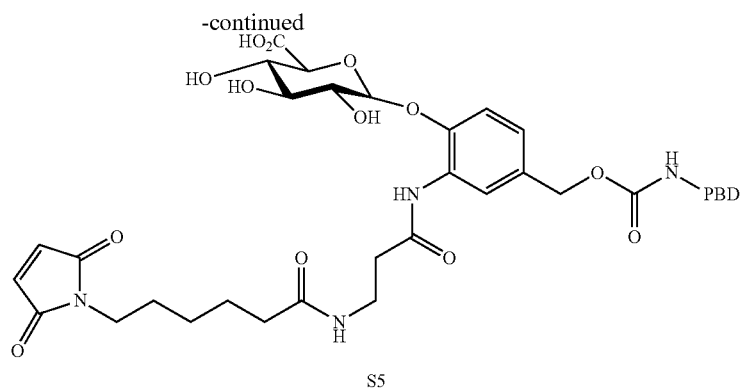

S5

The glucuronide linker intermediate S1 (reference: Jeffrey et al., *Bioconjugate Chemistry*, 2006, 17, 831-840) can be treated with diphosgene in dichlroromethane at −78° C. to afford the glucuronide chloroformate, which is then reacted with the PBD dimer S2 dissolved in $CH_2Cl_2$ by dropwise addition. Warming the reaction to 0° C. over 2 hours followed by extraction will yield the compound S3. Treating a solution of S3 in an equal solvent mixture of MeOH, tetrahydrofuran, and water (cooled to 0° C.) with lithium hydroxide monohydrate for 4 hours, followed by reaction with glacial acetic acid will yield the compound S4. Adding maleimidocaproyl NHS ester to a solution of S4 in DMF, followed by diisopropylethylamine and stirring at room temperature under nitrogen for 2 hours will yield the desired drug linker S5.

Scheme B

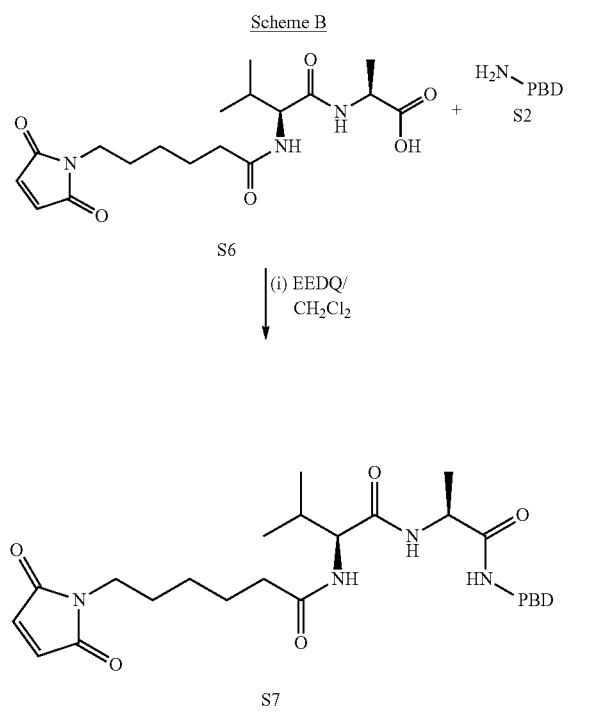

The maleimide linker S6, which can be synthesised by reacting maleimidocaproyl N-hydroxysuccinimide and H-Val-Ala-OH, can be linked to the exemplary compounds, S2, in the presence of EEDQ in anhydrous dichloromethane.

Scheme C

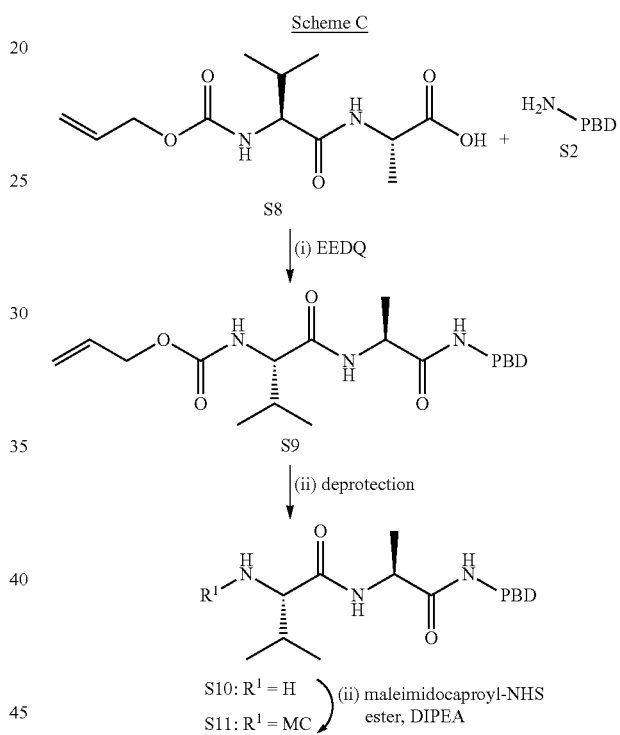

The linker S8 can be linked to the exemplary compounds, S2, in the presence of EEDQ in 5% methanol/dichloromethane. The deprotection of S9 can be carried out with the use of $Ph_3P$, pyrollidine and tetrakis palladium in anhydrous dichloromethane. S10 can be converted to the desired products by adding maleimidocaproyl-NHS ester, in the presence of DIPEA in DMF.

Further Preferences

The following preferences may apply to all aspects of the invention as described above, or may relate to a single aspect. The preferences may be combined together in any combination.

In some embodiments, $R^{6'}$, $R^{7'}$, $R^{9'}$, and Y' are preferably the same as $R^6$, $R^7$, $R^9$, and Y respectively.

Dimer Link

Y and Y' are preferably O.

R" is preferably a $C_{3-7}$ alkylene group with no substituents. More preferably R" is a $C_3$, $C_5$ or $C_7$ alkylene. Most preferably, R" is a $C_3$ or $C_5$ alkylene.

$R^6$ to $R^9$ $R^9$ is preferably H.

$R^6$ is preferably selected from H, OH, OR, SH, $NH_2$, nitro and halo, and is more preferably H or halo, and most preferably is H.

$R^7$ is preferably selected from H, OH, OR, SH, SR, $NH_2$, NHR, NRR', and halo, and more preferably independently selected from H, OH and OR, where R is preferably selected from optionally substituted $C_{1-7}$ alkyl, $C_{3-10}$ heterocyclyl and $C_{5-10}$ aryl groups. R may be more preferably a $C_1$ alkyl group, which may or may not be substituted. A substituent of interest is a $C_{5-6}$ aryl group (e.g. phenyl). Particularly preferred substituents at the 7-positions are OMe and $OCH_2Ph$. Other substituents of particular interest are dimethylamino (i.e. $-NMe_2$); $-(OC_2H_4)_qOMe$, where q is from 0 to 2; nitrogen-containing $C_6$ heterocyclyls, including morpholino, piperidinyl and N-methyl-piperazinyl.

These preferences apply to $R^{9'}$, $R^{6'}$ and $R^{7'}$ respectively.

$R^2$

In some embodiments, $R^2$ is of formula IIa.

A in $R^2$ when it is of formula IIa may be phenyl group or a $C_{5-7}$ heteroaryl group, for example furanyl, thiophenyl and pyridyl. In some embodiments, A is preferably phenyl.

$Q^2$-X may be on any of the available ring atoms of the $C_{5-7}$ aryl group, but is preferably on a ring atom that is not adjacent the bond to the remainder of the compound, i.e. it is preferably β or γ to the bond to the remainder of the compound. Therefore, where the $C_{5-7}$ aryl group (A) is phenyl, the substituent ($Q^2$-X) is preferably in the meta- or para-positions, and more preferably is in the para-position.

In some embodiments, $Q^1$ is a single bond. In these embodiments, $Q^2$ is selected from a single bond and —Z—$(CH_2)_n$—, where Z is selected from a single bond, O, S and NH and is from 1 to 3. In some of these embodiments, $Q^2$ is a single bond. In other embodiments, $Q^2$ is —Z—$(CH_2)_n$—. In these embodiments, Z may be O or S and n may be 1 or n may be 2. In other of these embodiments, Z may be a single bond and n may be 1.

In other embodiments, $Q^1$ is —CH=CH—.

In other embodiments, $R^2$ is of formula IIb. In these embodiments, $R^{C1}$, $R^{C2}$ and $R^{C3}$ are independently selected from H and unsubstituted $C_{1-2}$ alkyl. In some preferred embodiments, $R^{C1}$, $R^{C2}$ and $R^{C3}$ are all H. In other embodiments, $R^{C1}$, $R^{C2}$ and $R^{C3}$ are all methyl. In certain embodiments, $R^{C1}$, $R^{C2}$ and $R^{C3}$ are independently selected from H and methyl.

X is a group selected from the list comprising: OH, SH, $CO_2H$, COH, N=C=O, $NHNH_2$, $CONHNH_2$,

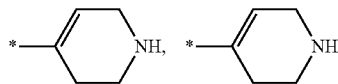

and $NHR^N$, wherein $R^N$ is selected from the group comprising H and $C_{1-4}$ alkyl. X may preferably be: OH, SH, $CO_2H$, —N=C=O or $NHR^N$, and may more preferably be: OH, SH, $CO_2H$, —N=C=O or $NH_2$. Particularly preferred groups include: OH, SH and $NH_2$, with $NH_2$ being the most preferred group.

In some embodiments $R^2$ is of formula IIc. In these embodiments, it is preferred that Q is $NR^N$. In other embodiments, Q is OH. In further embodiments, Q is SH. $R^N$ is preferably selected from H and methyl. In some embodiment, $R^N$ is H. In other embodiments, $R^N$ is methyl.

In some embodiments, $R^2$ may be -A-$CH_2$—X and -A-X. In these embodiments, X may be OH, SH, $CO_2H$, COH and $NH_2$. In particularly preferred embodiments, X may be $NH_2$.

$R^{12}$

When there is a double bond present between C2' and C3', $R^{12}$ is selected from:

(a) $C_{5-10}$ aryl group, optionally substituted by one or more substituents selected from the group comprising: halo, nitro, cyano, ether, $C_{1-7}$ alkyl, $C_{3-7}$ heterocyclyl and bis-oxy-$C_{1-3}$ alkylene;

(b) $C_{1-5}$ saturated aliphatic alkyl;

(c) $C_{3-6}$ saturated cycloalkyl;

(d)

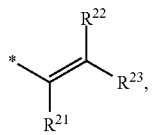

wherein each of $R^{21}$, $R^{22}$ and $R^{23}$ are independently selected from H, $C_{1-3}$ saturated alkyl, $C_{2-3}$ alkenyl, $C_{2-3}$ alkynyl and cyclopropyl, where the total number of carbon atoms in the $R^{12}$ group is no more than 5;

(e)

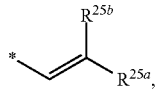

wherein one of $R^{25a}$ and $R^{25b}$ is H and the other is selected from: phenyl, which phenyl is optionally substituted by a group selected from halo methyl, methoxy; pyridyl; and thiophenyl; and (f)

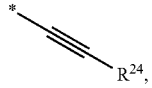

where $R^{24}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo methyl, methoxy; pyridyl; and thiophenyl.

When $R^{12}$ is a $C_{5-10}$ aryl group, it may be a $C_{5-7}$ aryl group. A $C_{5-7}$ aryl group may be a phenyl group or a $C_{5-7}$ heteroaryl group, for example furanyl, thiophenyl and pyridyl. In some embodiments, $R^{12}$ is preferably phenyl. In other embodiments, $R^{12}$ is preferably thiophenyl, for example, thiophen-2-yl and thiophen-3-yl.

When $R^{12}$ is a $C_{5-10}$ aryl group, it may be a $C_{8-10}$ aryl, for example a quinolinyl or isoquinolinyl group. The quinolinyl or isoquinolinyl group may be bound to the PBD core through any available ring position. For example, the quinolinyl may be quinolin-2-yl, quinolin-3-yl, quinolin-4-yl, quinolin-5-yl, quinolin-6-yl, quinolin-7-yl and quinolin-8-yl. Of these quinolin-3-yl and quinolin-6-yl may be preferred. The isoquinolinyl may be isoquinolin-1-yl, isoquinolin-3-yl, isoquinolin-4yl, isoquinolin-5-yl, isoquinolin-6- yl, isoquinolin-7-yl and isoquinolin-8-yl. Of these isoquinolin-3-yl and isoquinolin-6-yl may be preferred.

When $R^{12}$ is a $C_{5-10}$ aryl group, it may bear any number of substituent groups. It preferably bears from 1 to 3 substituent groups, with 1 and 2 being more preferred, and singly substituted groups being most preferred. The substituents may be any position.

Where $R^{12}$ is $C_{5-7}$ aryl group, a single substituent is preferably on a ring atom that is not adjacent the bond to the remainder of the compound, i.e. it is preferably β or γ to the bond to the remainder of the compound. Therefore, where the $C_{5-7}$ aryl group is phenyl, the substituent is preferably in the meta- or para-positions, and more preferably is in the para-position.

Where $R^{12}$ is a $C_{8-10}$ aryl group, for example quinolinyl or isoquinolinyl, it may bear any number of substituents at any position of the quinoline or isoquinoline rings. In some embodiments, it bears one, two or three substituents, and these may be on either the proximal and distal rings or both (if more than one substituent).

$R^{12}$ Substituents, when $R^{12}$ is a $C_{5-10}$ Aryl Group

If a substituent on $R^{12}$ when $R^{12}$ is a $C_{5-10}$ aryl group is halo, it is preferably F or Cl, more preferably Cl.

If a substituent on $R^{12}$ when $R^{12}$ is a $C_{5-10}$ aryl group is ether, it may in some embodiments be an alkoxy group, for example, a $C_{1-7}$ alkoxy group (e.g. methoxy, ethoxy) or it may in some embodiments be a $C_{5-7}$ aryloxy group (e.g. phenoxy, pyridyloxy, furanyloxy). The alkoxy group may itself be further substituted, for example by an amino group (e.g. dimethylamino).

If a substituent on $R^{12}$ when $R^{12}$ is a $C_{5-10}$ aryl group is $C_{1-7}$ alkyl, it may preferably be a $C_{1-4}$ alkyl group (e.g. methyl, ethyl, propryl, butyl).

If a substituent on $R^{12}$ when $R^{12}$ is a $C_{5-10}$ aryl group is $C_{3-7}$ heterocyclyl, it may in some embodiments be $C_6$ nitrogen containing heterocyclyl group, e.g. morpholino, thiomorpholino, piperidinyl, piperazinyl. These groups may be bound to the rest of the PBD moiety via the nitrogen atom. These groups may be further substituted, for example, by $C_{1-4}$ alkyl groups. If the $C_6$ nitrogen containing heterocyclyl group is piperazinyl, the said further substituent may be on the second nitrogen ring atom.

If a substituent on $R^{12}$ when $R^{12}$ is a $C_{5-10}$ aryl group is bis-oxy-$C_{1-3}$ alkylene, this is preferably bis-oxy-methylene or bis-oxy-ethylene.

If a substituent on $R^{12}$ when $R^{12}$ is a $C_{5-10}$ aryl group is ester, this is preferably methyl ester or ethyl ester.

Particularly preferred substituents when $R^{12}$ is a $C_{5-10}$ aryl group include methoxy, ethoxy, fluoro, chloro, cyano, bis-oxy-methylene, methyl-piperazinyl, morpholino and methyl-thiophenyl. Other particularly preferred substituents for $R^{12}$ are dimethylaminopropyloxy and carboxy.

Particularly preferred substituted $R^{12}$ groups when $R^{12}$ is a $C_{5-10}$ aryl group include, but are not limited to, 4-methoxy-phenyl, 3-methoxyphenyl, 4-ethoxy-phenyl, 3-ethoxy-phenyl, 4-fluoro-phenyl, 4-chloro-phenyl, 3,4-bisoxymethylene-phenyl, 4-methylthiophenyl, 4-cyanophenyl, 4-phenoxyphenyl, quinolin-3-yl and quinolin-6-yl, isoquinolin-3-yl and isoquinolin-6-yl, 2-thienyl, 2-furanyl, methoxynaphthyl, and naphthyl. Another possible substituted $R^{12}$ group is 4-nitrophenyl. $R^{12}$ groups of particular interest include 4-(4-methylpiperazin-1-yl)phenyl and 3,4-bisoxymethylene-phenyl.

When $R^{12}$ is $C_{1-5}$ saturated aliphatic alkyl, it may be methyl, ethyl, propyl, butyl or pentyl. In some embodiments, it may be methyl, ethyl or propyl (n-pentyl or isopropyl). In some of these embodiments, it may be methyl. In other embodiments, it may be butyl or pentyl, which may be linear or branched.

When $R^{12}$ is $C_{3-6}$ saturated cycloalkyl, it may be cyclopropyl, cyclobutyl, cyclopentyl or cyclohexyl. In some embodiments, it may be cyclopropyl.

When $R^{12}$ is

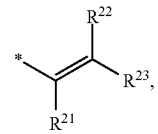

each of $R^{21}$, $R^{22}$ and $R^{23}$ are independently selected from H, $C_{1-3}$ saturated alkyl, $C_{2-3}$ alkenyl, $C_{2-3}$ alkynyl and cyclopropyl, where the total number of carbon atoms in the $R^{12}$ group is no more than 5. In some embodiments, the total number of carbon atoms in the $R^{12}$ group is no more than 4 or no more than 3.

In some embodiments, one of $R^{21}$, $R^{22}$ and $R^{23}$ is H, with the other two groups being selected from H, $C_{1-3}$ saturated alkyl, $C_{2-3}$ alkenyl, $C_{2-3}$ alkynyl and cyclopropyl.

In other embodiments, two of $R^{21}$, $R^{22}$ and $R^{23}$ are H, with the other group being selected from H, $C_{1-3}$ saturated alkyl, $C_{2-3}$ alkenyl, $C_{2-3}$ alkynyl and cyclopropyl.

In some embodiments, the groups that are not H are selected from methyl and ethyl. In some of these embodiments, the groups that re not H are methyl.

In some embodiments, $R^{21}$ is H.
In some embodiments, $R^{22}$ is H.
In some embodiments, $R^{23}$ is H.
In some embodiments, $R^{21}$ and $R^{22}$ are H.
In some embodiments, $R^{21}$ and $R^{23}$ are H.
In some embodiments, $R^{22}$ and $R^{23}$ are H.

An $R^{12}$ group of particular interest is:

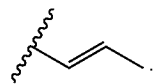

When $R^{12}$ is

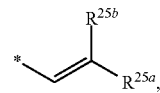

one of $R^{25a}$ and $R^{25b}$ is H and the other is selected from: phenyl, which phenyl is optionally substituted by a group selected from halo, methyl, methoxy; pyridyl; and thiophenyl. In some embodiments, the group which is not H is optionally substituted phenyl. If the phenyl optional substituent is halo, it is preferably fluoro. In some embodiment, the phenyl group is unsubstituted.

When $R^{12}$ is

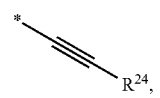

$R^{24}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo methyl, methoxy; pyridyl; and thiophenyl. If the phenyl optional substituent is halo, it is preferably fluoro. In some embodiment, the phenyl group is unsubstituted.

In some embodiments, $R^{24}$ is selected from H, methyl, ethyl, ethenyl and ethynyl. In some of these embodiments, $R^{24}$ is selected from H and methyl.

When there is a single bond present between C2' and C3', $R^{12}$ is H or

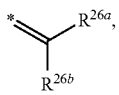

where $R^{26a}$ and $R^{26b}$ are independently selected from H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{26a}$ and $R^{26b}$ is H, the other is selected from nitrile and a $C_{1-4}$ alkyl ester.

In some embodiments, $R^{12}$ is H.
In some embodiments, $R^{12}$ is

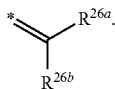

In some embodiments, it is preferred that $R^{26a}$ and $R^{26b}$ are both H.

In other embodiments, it is preferred that $R^{26a}$ and $R^{26b}$ are both methyl.

In further embodiments, it is preferred that one of $R^{26a}$ and $R^{26b}$ is H, and the other is selected from $C_{1-4}$ saturated alkyl, $C_{2-3}$ alkenyl, which alkyl and alkenyl groups are optionally substituted. In these further embodiment, it may be further preferred that the group which is not H is selected from methyl and ethyl.

$R^{10}$, $R^{11a}$, $R^{11b}$, $R^{20}$, $R^{21a}$, $R^{21b}$

In some embodiments, $R^{20}$ is H and $R^{21a}$ and $R^{21b}$ are both H. Alternatively, $R^{20}$ may be Me when $R^{21a}$ and $R^{21b}$ are both H.

In some embodiments, $R^{20}$ is H and $R^{21a}$ and $R^{21b}$ are together form =O. Alternatively, $R^{20}$ may be Me when $R^{21a}$ and $R^{21b}$ together form =O.

In either of these sets of embodiments, it may be preferred that $R^{10}$ and $R^{11b}$ form a nitrogen-carbon double bond between the nitrogen and carbon atoms to which they are bound and $R^{11a}$ is H. It may be alternatively preferred that $R^{10}$ is H, $R^{11a}$ is H and $R^{11b}$ is OH. It may be further alternatively preferred that $R^{10}$ is H, $R^{11a}$ is H and $R^{11b}$ is $SO_zM$, where z is 2 or 3 and M is a monovalent pharmaceutically acceptable cation.

In some embodiments, $R^{10}$ is H and $R^{11a}$ and $R^{11b}$ are both H. Alternatively, $R^{10}$ may be Me when $R^{11a}$ and $R^{11b}$ are both H.

In some embodiments, $R^{10}$ is H and $R^{11a}$ and $R^{11b}$ together form =O. Alternatively, $R^{10}$ may be Me when $R^{11a}$ and $R^{11b}$ together form =O.

In either of these sets of embodiments, it may be preferred that $R^{20}$ and $R^{21b}$ form a nitrogen-carbon double bond between the nitrogen and carbon atoms to which they are H, bound and $R^{21a}$ is H. It may be alternatively preferred that $R^{20}$ is H, $R^{21a}$ is H and $R^{21b}$ is OH. It may be further alternatively preferred that $R^{20}$ is H, $R^{21a}$ is H and $R^{21b}$ is $SO_zM$, where z is 2 or 3 and M is a monovalent pharmaceutically acceptable cation.

M and z

It is preferred that M is a monovalent pharmaceutically acceptable cation, and is more preferably Na$^+$.

z is preferably 3.

Fourth Aspect $L^4$

In some embodiments, $L^4$ is a single bond.
In some embodiments, $L^4$ is:

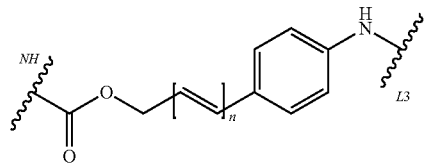

wherein n is 0 to 3. In these embodiments, n can be 0, 1, 2 or 3. n=0 and n=1 may be preferred.

In some embodiments, $L^4$ is:

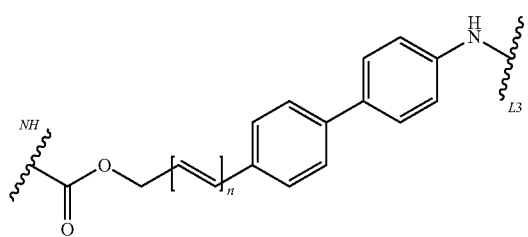

wherein n is 0 to 3. In these embodiments, n can be 0, 1, 2 or 3. n=0 and n=1 may be preferred.

In some embodiments, $L^4$ is:

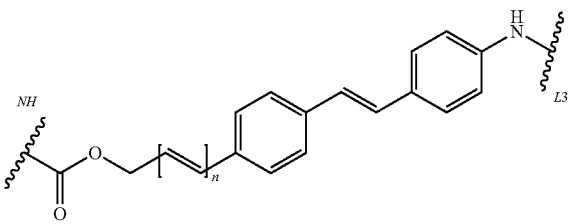

wherein n is 0 to 3. In these embodiments, n can be 0, 1, 2 or 3. n=0 and n=1 may be preferred.

In some embodiments, $L^4$ is:

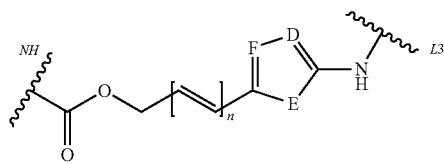

wherein n is 0 to 3. In these embodiments, n can be 0, 1, 2 or 3. n=0 and n=1 may be preferred. In one of these embodiments, D is N. In other of these embodiments, D is CH. In one of these embodiments, E is O or S. In one these embodiments, F is CH.

L³

In one embodiment, L³ is an amino acid residue. The amino acid may a natural amino acids or a non-natural amino acid.

In one embodiment, L³ is selected from: Phe, Lys, Val, Ala, Cit, Leu, Ile, Arg, and Trp, where Cit is citrulline.

In one embodiment, L³ comprises a dipeptide residue. The amino acids in the dipeptide may be any combination of natural amino acids and non-natural amino acids. In some embodiments, the dipeptide comprises natural amino acids. Where the linker is a cathepsin labile linker, the dipeptide is the site of action for cathepsin-mediated cleavage. The dipeptide then is a recognition site for cathepsin.

In one embodiment, L³ is selected from:
$^{Prot}$-Phe-Lys-$^{L4}$,
$^{Prot}$-Val-Ala-$^{L4}$,
$^{Prot}$-Val-Lys-$^{L4}$,
$^{Prot}$-Ala-Lys-$^{L4}$,
$^{Prot}$-Val-Cit-$^{L4}$,
$^{Prot}$-Phe-Cit-$^{L4}$,
$^{Prot}$-Leu-Cit-$^{L4}$,
$^{Prot}$-Ile-Cit-$^{L4}$,
$^{Prot}$-Phe-Arg-$^{L4}$, and
$^{Prot}$-Trp-Cit-$^{L4}$;
where Cit is citrulline.

Preferably, L³ is selected from:
$^{Prot}$-Phe-Lys-$^{L4}$,
$^{Prot}$-Val-Ala-$^{L4}$,
$^{Prot}$-Val-Lys-$^{L4}$,
$^{Prot}$-Ala-Lys-$^{L4}$, and
$^{Prot}$-Val-Cit-$^{L4}$.

Most preferably, L³ is selected from $^{Prot}$-Phe-Lys-$^{L4}$, $^{Prot}$-Val-Cit-$^{L4}$ or $^{Prot}$-Val-Ala-$^{L4}$.

Other dipeptide combinations of interest include:
$^{Prot}$-Gly-Gly-$^{L4}$,
$^{Prot}$-Pro-Pro-$^{L4}$, and
$^{Prot}$-Val-Glu-$^{L4}$.

Other dipeptide combinations may be used, including those described by Dubowchik et al., *Bioconjugate Chemistry*, 2002, 13, 855-869, which is incorporated herein by reference.

In some embodiments, L³ is a tripeptide residue. The amino acids in the tripeptide may be any combination of natural amino acids and non-natural amino acids. In some embodiments, the tripeptide comprises natural amino acids. Where the linker is a cathepsin labile linker, the tripeptide is the site of action for cathepsin-mediated cleavage. The tripeptide then is a recognition site for cathepsin.

In one embodiment, the amino acid side chain is chemically protected, where appropriate. The side chain protecting group may be a group as discussed below. Protected amino acid sequences are cleavable by enzymes. For example, a dipeptide sequence comprising a Boc side chain-protected Lys residue is cleavable by cathepsin.

Protecting groups for the side chains of amino acids are well known in the art and are described in the Novabiochem Catalog, and as described above.

Prot

Prot is selected from Fmoc (fluorenylmethyloxycarbonyl), Teoc (2-(trimethylsilyl)ethoxycarbonyl), Boc (t-butoxycarbonyl) and Alloc (alylocycarbonyl). In some embodiments, Prot is selected from Fmoc and Teoc.

In some embodiments, Prot is Fmoc.
In some embodiments, Prot is Teoc.

Particularly preferred compounds of the first aspect of the present invention are of formula Ia-1, Ia-2, Ia-3 or Ia-4:

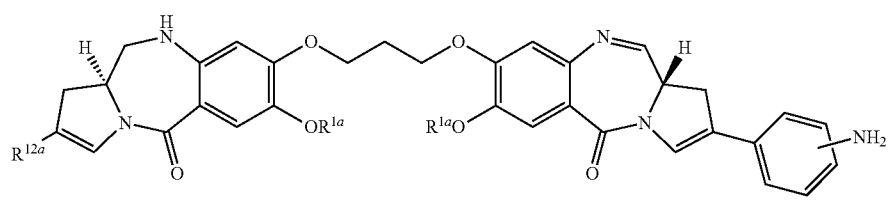

Ia-1

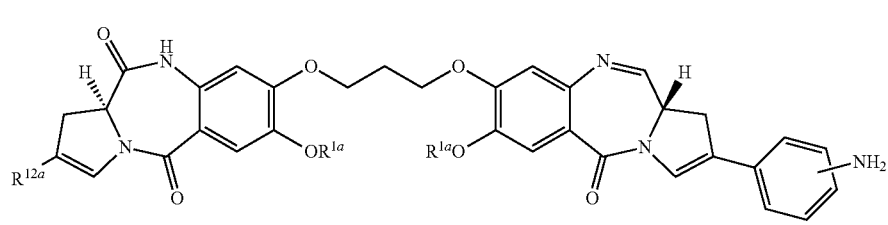

Ia-2

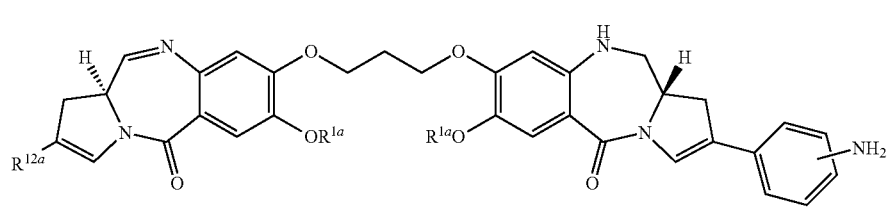

Ia-3

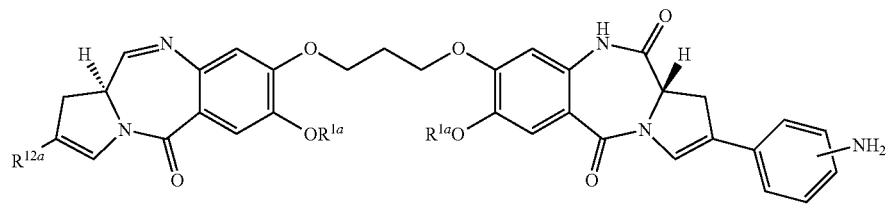
Ia-4
where R$^{12a}$ is selected from:
(a)
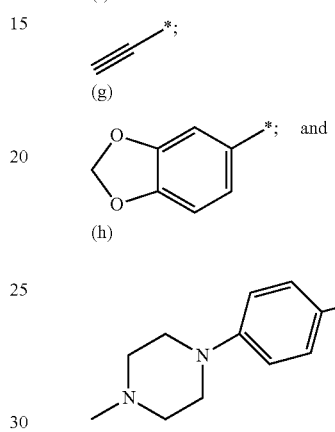
(b)
(c)
(d)
(e)
(f)
(g)
(h)
the amino group is at either the meta or para positions of the phenyl group.
Further particularly preferred compounds of the first aspect of the present invention are of formula Ib-1, Ib-2, Ib-3 or Ib-4:
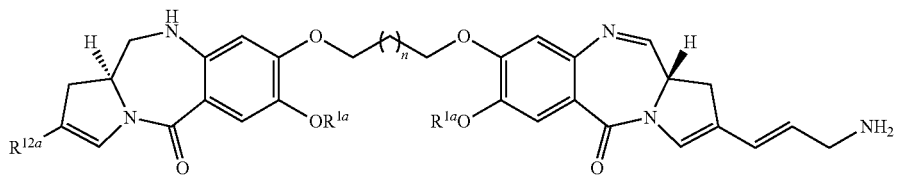
Ib-1
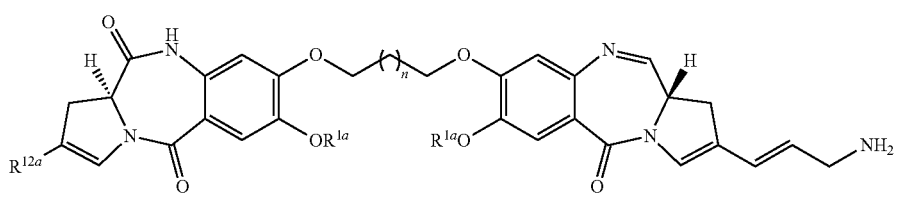
Ib-2
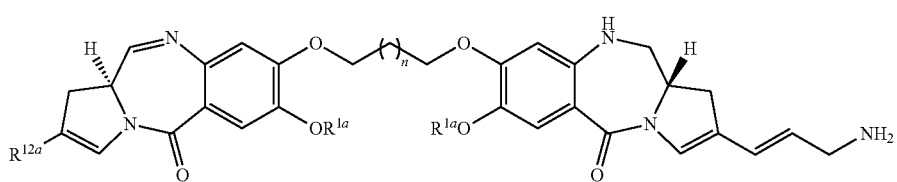
Ib-3

Ib-4
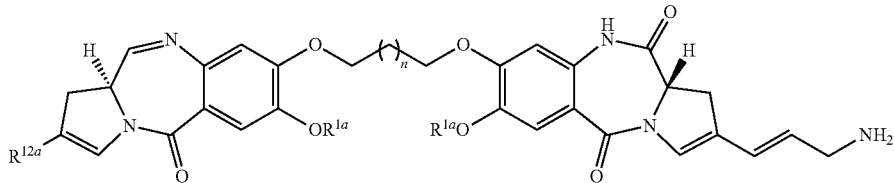
where
n is 1 or 3;
$R^{1a}$ is methyl or phenyl;
$R^{12a}$ is selected from:
(a)
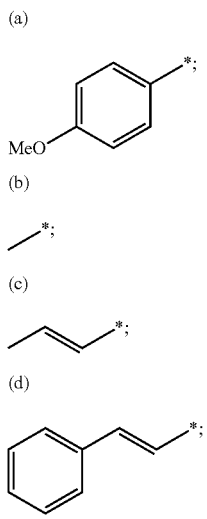
(b), (c), (d)
(e) 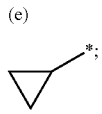
(f) 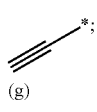
(g) 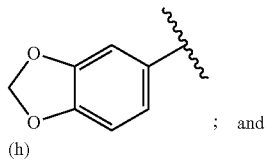
; and
(h) 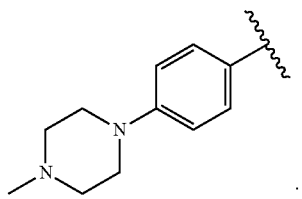
Further particularly preferred compounds of the first aspect of the present invention are of formula Ic-1, Ic-2, Ic-3 or Ic-4:
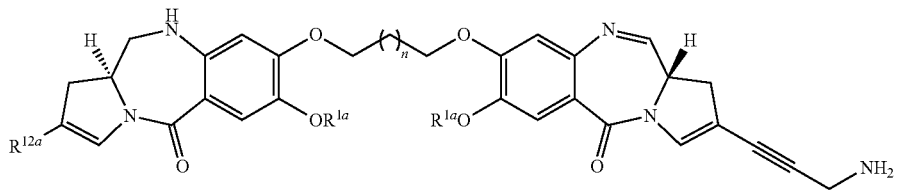
ic-1
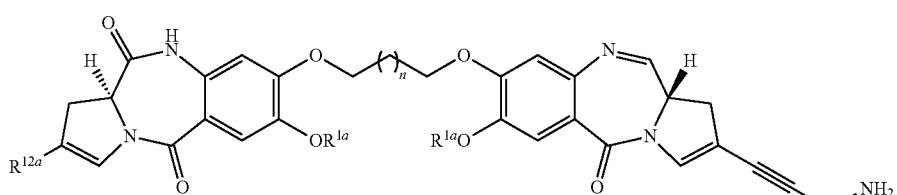
ic-2
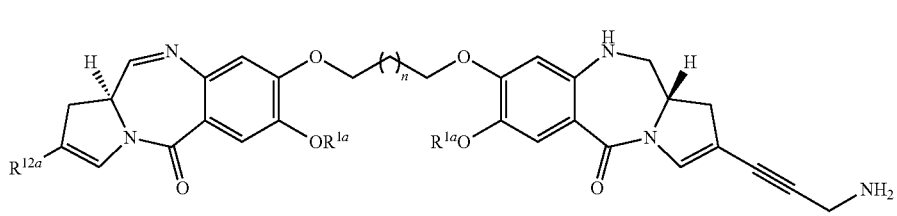
ic-3

-continued ic-4 where
n is 1 or 3;
$R^{1a}$ is methyl or phenyl;
$R^{12a}$ is selected from:

(a) [structure: 4-methoxyphenyl]

(b) [structure: methyl]

(c) [structure: propenyl]

(d) [structure: styryl]

(e) [structure: cyclopropyl]

(f) [structure: ethynyl]

(g) [structure: benzodioxole]; and (h) [structure: methylpiperazinyl-phenyl]

Fifth Aspect

The preferences for compounds of formula I apply as appropriate to D in the fifth aspect of the invention. For example, in the fifth aspect, the PBD dimer is any of the compounds of formula I, or a pharmaceutically acceptable salt or solvate thereof, described herein expect that,

[structure: *—N(piperazine)NH]

is replaced with

[structure: *—N(piperazine)N—], [structure: *—(tetrahydropyridine)NH]

is replaced with

[structure: *—(tetrahydropyridine)N—], and *—NHR$^N$ is replaced with

[structure: *—N(R$^N$)—]

where the wavy line indicates the point of attachment to the Linker Unit.

Accordingly, the Conjugates of the present invention include those having the following formula (V)

L-(LU-D)$_p$     (V)

or a pharmaceutically acceptable salt or solvate thereof, wherein L is a Ligand unit (i.e., a targeting agent), LU is a Linker unit and the PBD dimer D. D is any of the compounds of formula I, or a pharmaceutically acceptable salt or solvate thereof, described herein expect that,

[structure: *—N(piperazine)NH]

is replaced with

[structure: *—N(piperazine)N—], [structure: *—(tetrahydropyridine)NH]

is replaced with

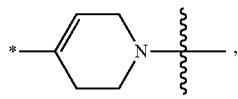

and *—NHR$^N$ is replaced with

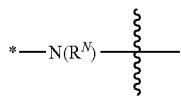

where the wavy line indicates the point of attachment to the Linker Unit.

(a) Conjugates of the present invention include, for example, those of the formula:

CBA-A$^1$-L$^1$-* where the asterisk indicates the point of attachment to the PBD dimer (D), CBA is the Cell Binding Agent, L$^1$ is a Specificity unit that is cleavable by the action of an enzyme, and A$^1$ is a Stretcher unit connecting L$^1$ to the Cell Binding Agent.

(b) Conjugates of the present invention include, for example, those of the formula:

CBA-A$^1$-L$^1$-* where the asterisk indicates the point of attachment to the PBD dimer (D), CBA is the Cell Binding Agent, A$^1$ is a Stretcher unit connecting L$^1$ to the Cell Binding Agent and L$^1$ is a Specificity unit that is cleavable by the action of cathepsin, L$^1$ is a dipeptide, L$^1$ is a dipeptide that is cleavable by the action of cathepsin or L$^1$ is a dipeptide selected from -Phe-Lys-, -Val-Ala-, -Val-Lys-, -Ala-Lys-, and -Val-Cit-.

Preferred conjugates of the present invention include any of those described in (a) and (b) wherein A$^1$ is

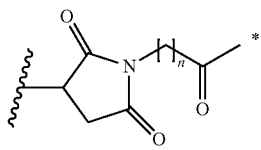

where the asterisk indicates the point of attachment to L$^1$, the wavy line indicates the point of attachment to CBA, and n is 0 to 6 (preferably n is 5).

Illustrative Synthetic Schemes

The following schemes illustrate a way of making certain compounds of the present invention, in which certain groups are illustrated generically as R, R' and R$_2$. The groups of which these form a part should be interpreted in accordance with the disclosure of the invention. In schemes where protecting groups are explicitly described, these may also be varied within the scope of the present invention.

Scheme 1a-synthesis of amine building block

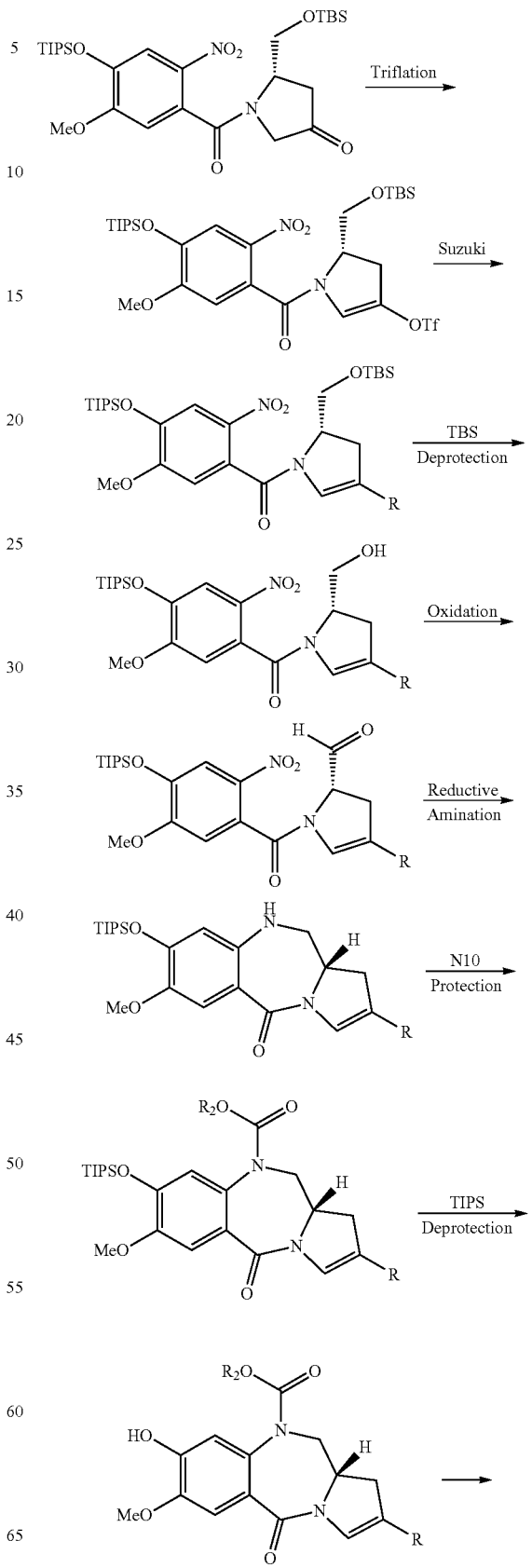

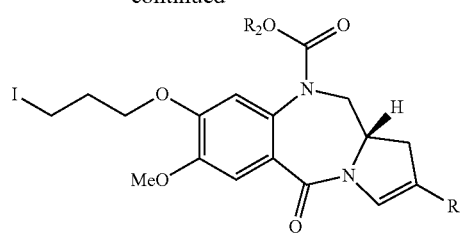
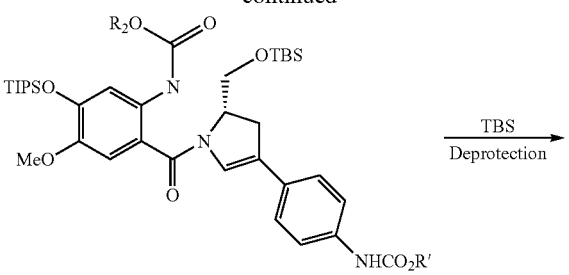
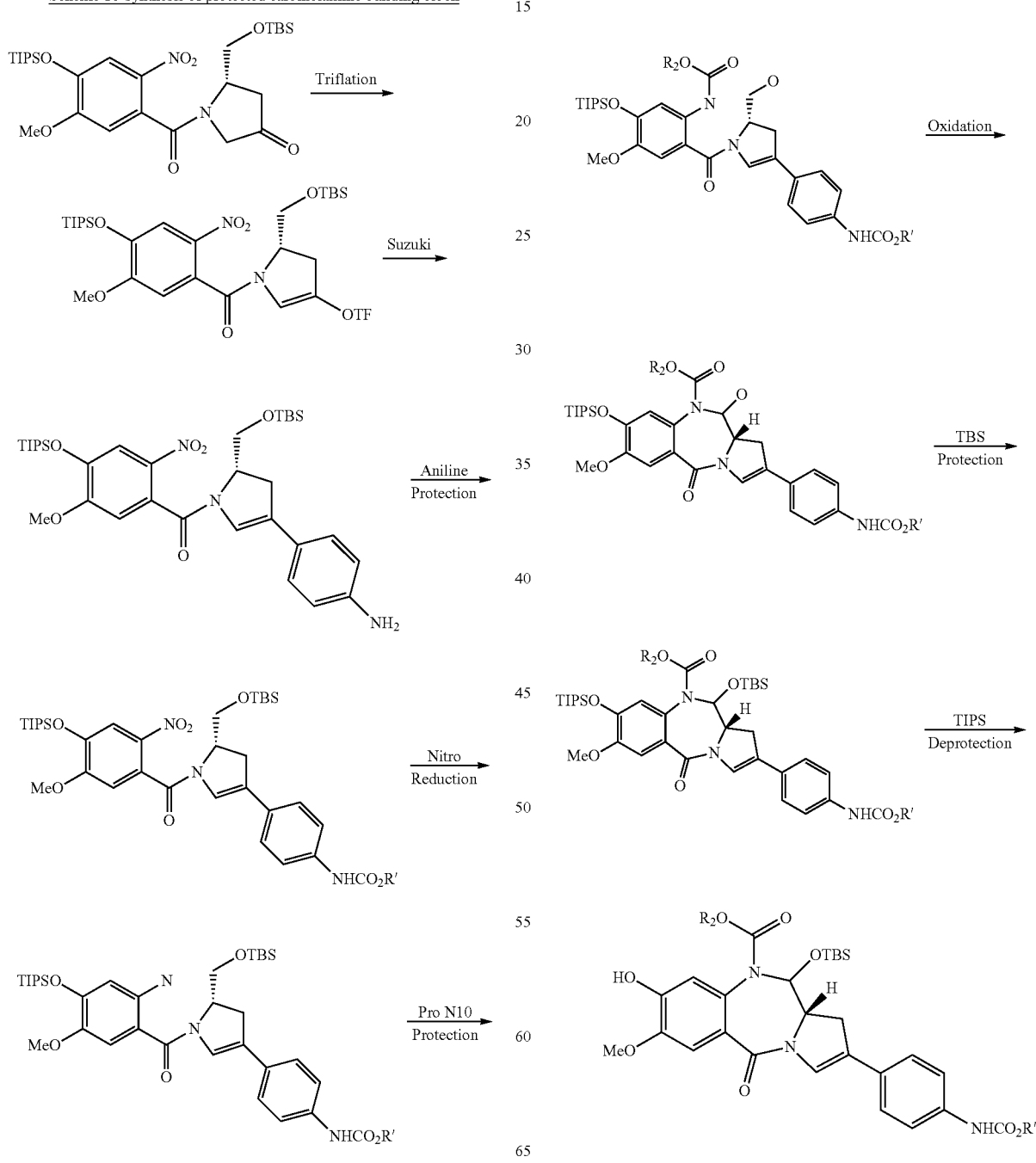
Scheme 1b-synthesis of protected carbinolamine building block Scheme 1c-synthesis of dimer with linker attached (drug-linker)
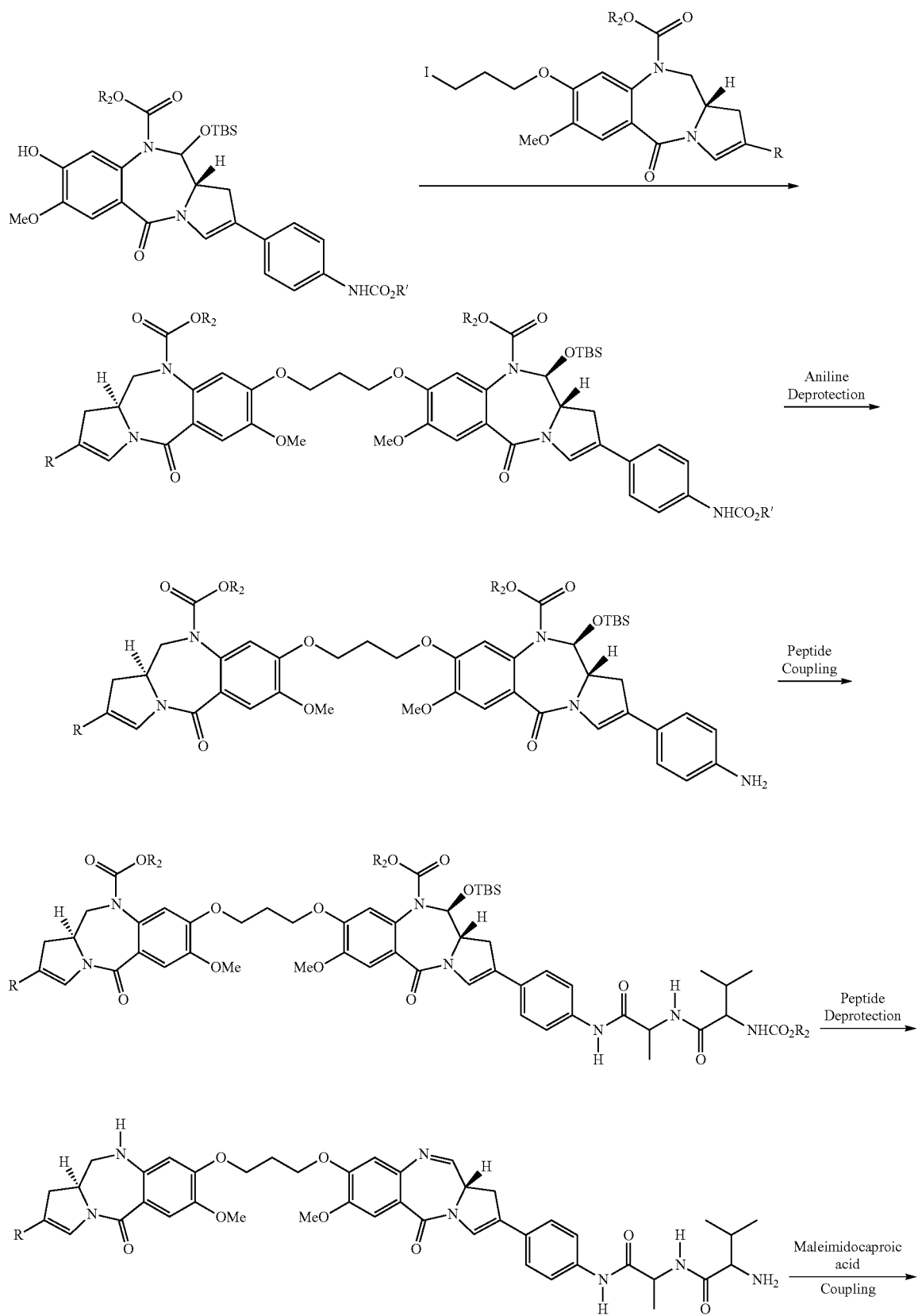

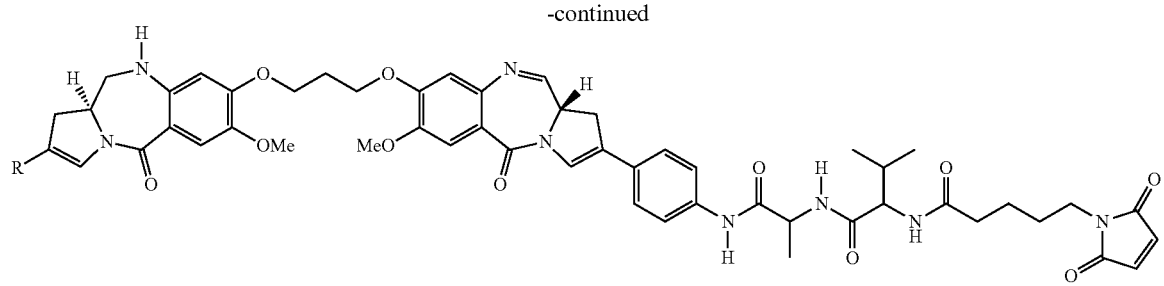
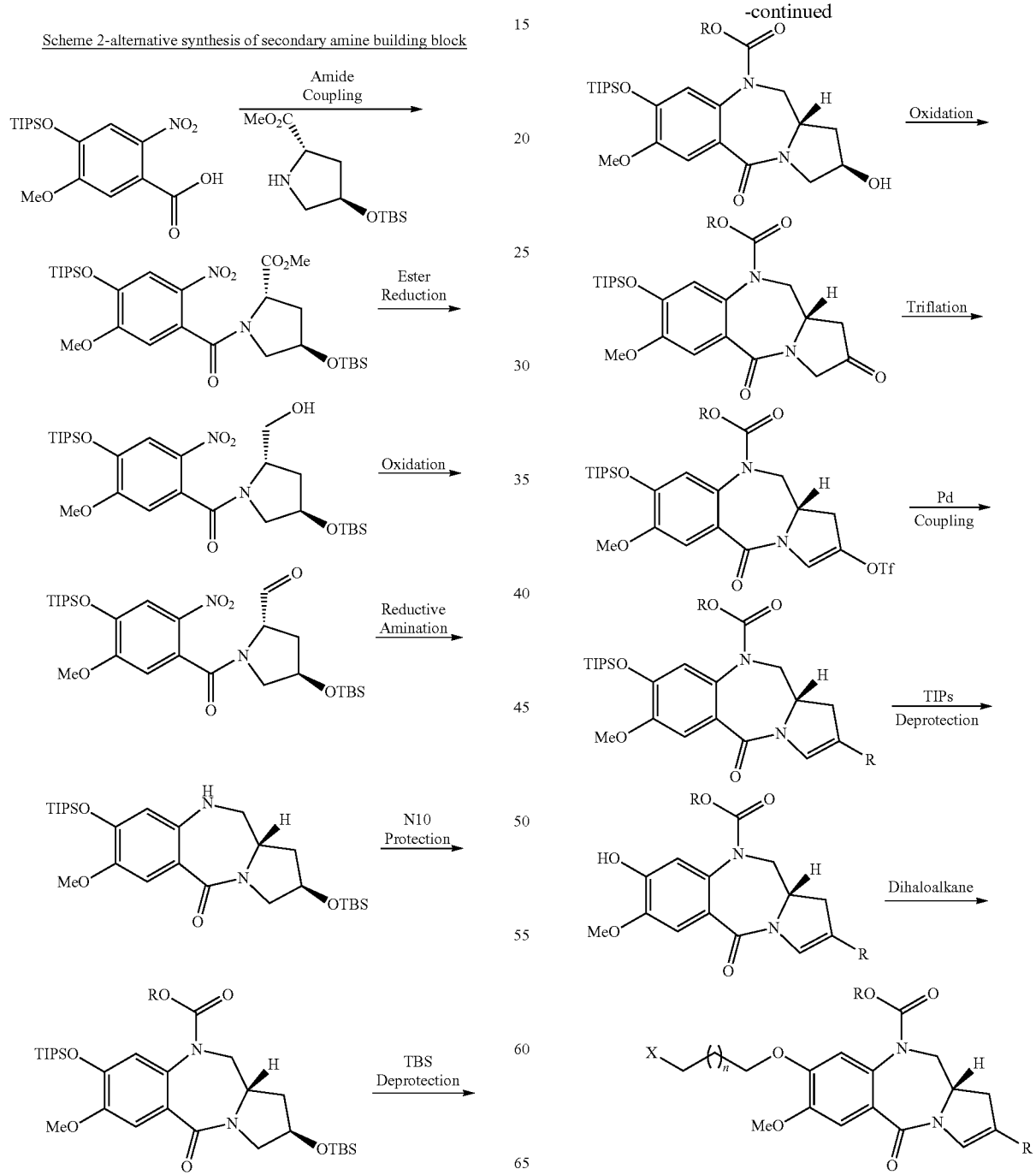

Scheme 3a-synthesis of dilactam building block
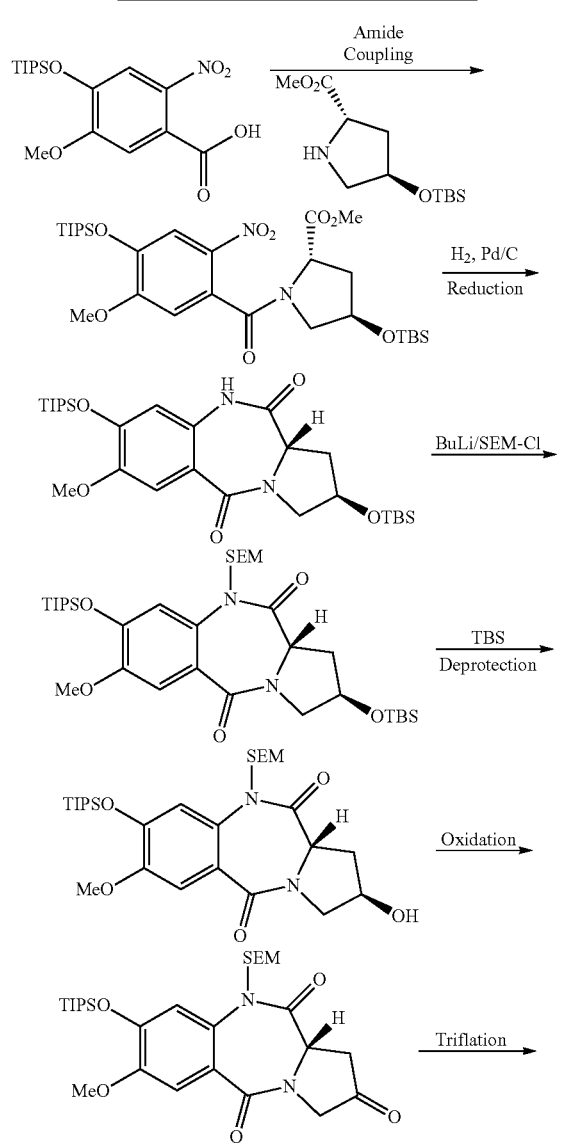
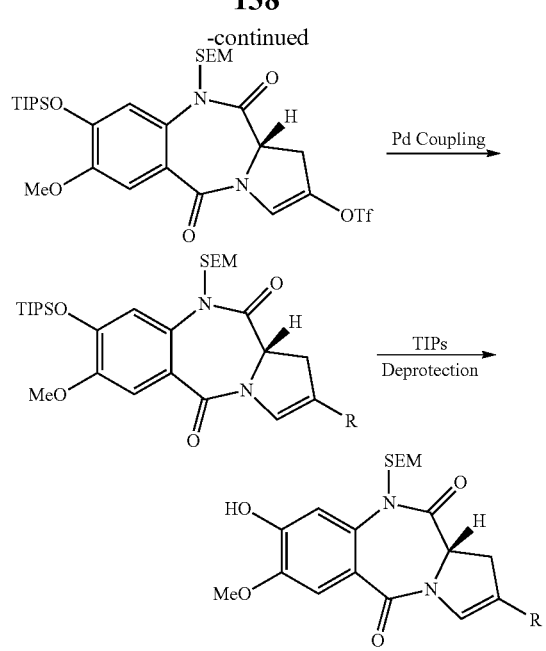
Scheme 3b-synthesis of protected carbinolamine building block with tether
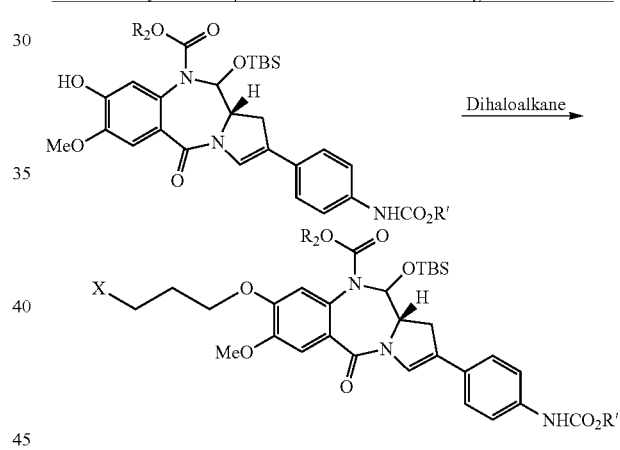
Scheme 3c-synthesis of dimer with linker attached (drug-linker)
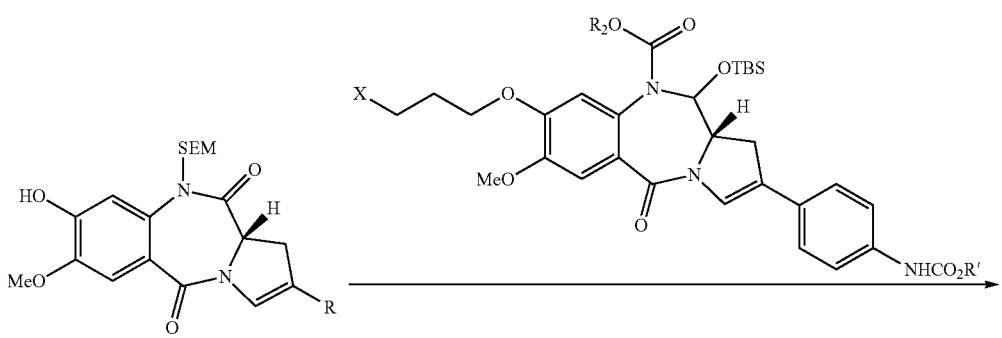

-continued
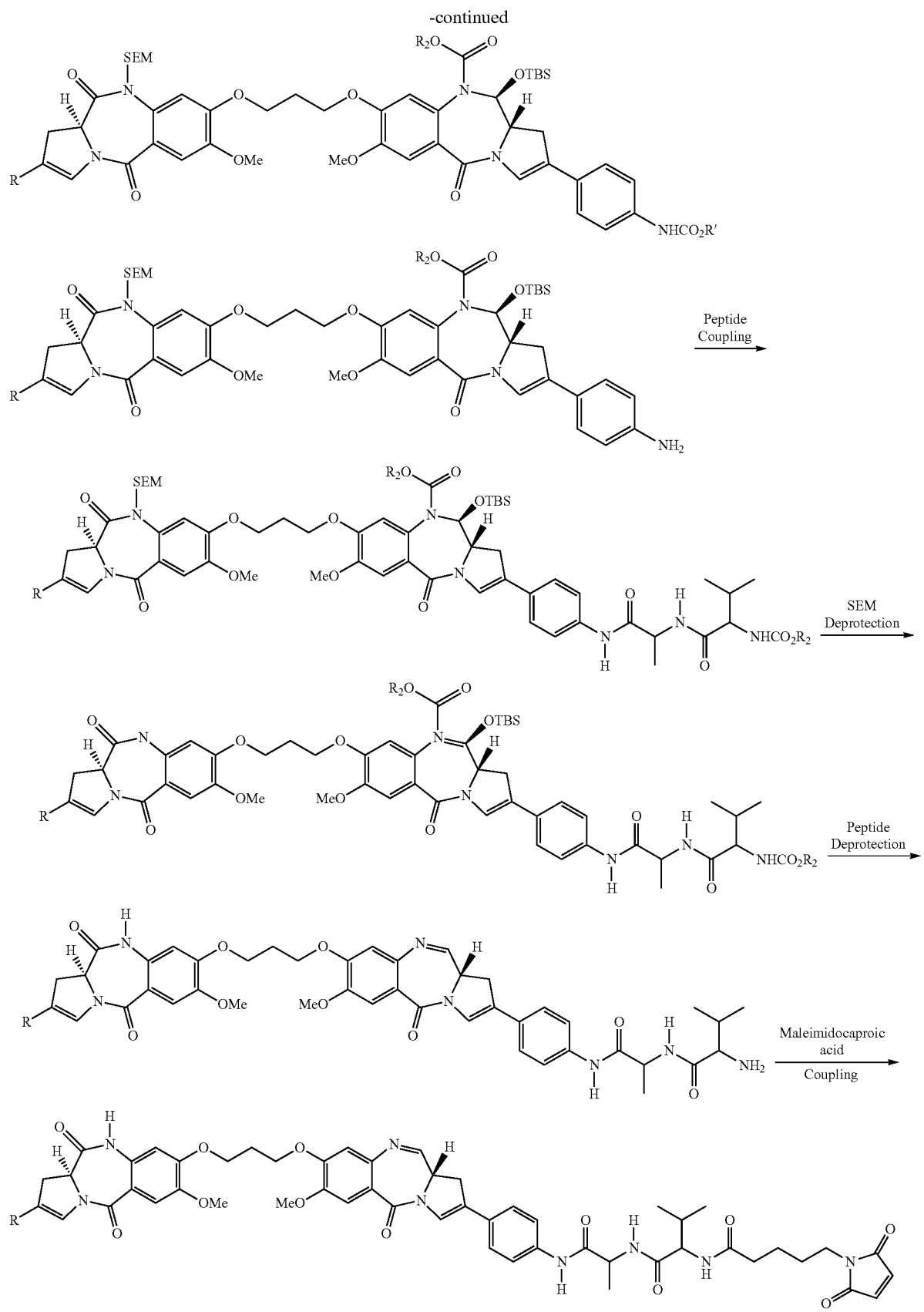

In the above schemes, the protecting groups may be orthogonal to one another to provide for synthetic flexibility.

EXAMPLES

General Experimental Methods

Reaction progress was monitored by thin-layer chromatography (TLC) using Merck Kieselgel 60 F254 silica gel, with fluorescent indicator on aluminium plates. Visualisation of TLC was achieved with UV light or iodine vapour unless otherwise stated. Flash chromatography was performed using Merck Kieselgel 60 F254 silica gel. Extraction and chromatography solvents were bought and used without further purification from Fisher Scientific, U.K. All chemicals were purchased from Aldrich, Lancaster or BDH.

$^1$H and $^{13}$C NMR spectra were obtained on a Bruker Avance 400 spectrometer. Coupling constants are quoted in hertz (Hz). Chemical shifts are recorded in parts per million (ppm) downfield from tetramethylsilane. Spin multiplicities are described as s (singlet), bs (broad singlet), d (doublet), t (triplet), q (quartet), p (pentuplet) and m (multiplet). IR spectra were recorded on a Perkin-Elmer FT/IR paragon 1000 spectrophotometer by application of the sample in a solution of chloroform using the ATR "golden gate" system. Optical rotations were measured at ambient temperature using a Bellingham and Stanley ADP 220 polarimeter. Mass spectrometry was performed on a ThermoQuest Navigator from Thermo Electron, Electrospray (ES) spectra were obtained at 20 to 30 V. Accurate mass measurements were performed using Micromass Q-TOF global tandem. All samples were run under electrospray ionization mode using 50% acetonitrile in water and 0.1% formic acid as a solvent. Samples were run on W mode which gives a typical resolution of 19000 at FWHH. The instrument was calibrated with [Glu]-Fibrinopeptide B immediately prior to measurement.

General LC/MS Conditions:
Method 1 (Default Method, Used Unless Stated Otherwise)
The HPLC (Waters Alliance 2695) was run using a mobile phase of water (A) (formic acid 0.1%) and acetonitrile (B) (formic acid 0.1%). Gradient: initial composition 5% B held over 1.0 min, then increase from 5% B to 95% B over a 3 min period. The composition was held for 0.1 min at 95% B, then returned to 5% B in 0.03 minutes and hold there for 0.87 min. Total gradient run time equals 5 minutes.

Flow rate 3.0 mL/min, 400 µL was split via a zero dead volume tee piece which passes into the mass spectrometer. Wavelength detection range: 220 to 400 nm. Function type: diode array (535 scans). Column: Phenomenex Onyx Monolithic C18 50×4.60 mm.

The reverse phase flash purification conditions were as follows: The Flash purification system (Varian 971-Fp) was run using a mobile phase of water (A) and acetonitrile (B). Gradient: initial composition 5% B over 20 C.V. (Column Volume) then 5% B to 70% B within 60 C.V. The composition was held for 15 C.V. at 95% B, and then returned to 5% B in 5 C.V. and held at 5% B for 10 C.V. Total gradient run time equals 120 C.V. Flow rate 6.0 mL/min. Wavelength detection range: 254 nm. Column: Agilent AX1372-1 SF10-5.5 gC8.

Fast Formic:
Positive mode electrospray mass spectrometry (ESI-MS) was performed using a Shimazu LCMS-2020 (single quadrupole mass spectrometer). Mobile phase used were water (A) (formic acid 0.1%) and acetonitrile (B) (formic acid 0.1%). Gradient: initial composition 5% B held over 0.25 min, then increase from 5% B to 100% B over a 2 min period. The composition was held for 0.50 min at 100% B, then returned to 5% B in 0.05 minutes and hold there for 0.05 min. Total gradient run time equals 3 min. Flow rate 0.8 mL/min. Wavelength detection range: 220 to 400 nm. Column: Waters Acquity UPLC BEH Shield RP18 1.7 µm 2.1×50 mm.

C18 15 min Formic:
Positive mode electrospray mass spectrometry (ESI-MS) was performed using a Shimazu LCMS-2020 (single quadrupole mass spectrometer). Oven temperature 50° C. Mobile phase used were water (A) (formic acid 0.1%) and acetonitrile (B) (formic acid 0.1%). Gradient: initial composition 5% B held over 1 min, then increase from 5% B to 100% B over a 9 min period. The composition was held for 2 min at 100% B, then returned to 5% B in 0.10 minutes and hold there for 2.90 min. Total gradient run time equals 15 min. Flow rate 0.6 mL/min. Wavelength detection range: 220 to 400 nm. Column: Gemini-NX UPLC C18 3 µm 2×100 mm.

Preparative HPLC: Reverse-phase ultra-high-performance liquid chromatography (UPLC) was carried out on Phenomenex Gemini NX 5µ C-18 columns of the following dimensions: 150×4.6 mm for analysis, and 150×21.20 mm for preparative work. All UPLC experiments were performed with gradient conditions: initial fixed composition 13% B to 75% B over 15 min, held for 2.0 min at 75% B, then 75% B to 13% B within 0.10 min held at 13% for 2.90 min. Total duration of gradient run was 20.00 min. Eluents used were solvent A (H$_2$O with 0.1% Formic acid) and solvent B (CH$_3$CN with 0.1% Formic acid). Flow rates used were 1.0 ml/min for analytical, and 20.0 ml/min for preparative HPLC. Detection was at 254 and 280 nm.

Example 1

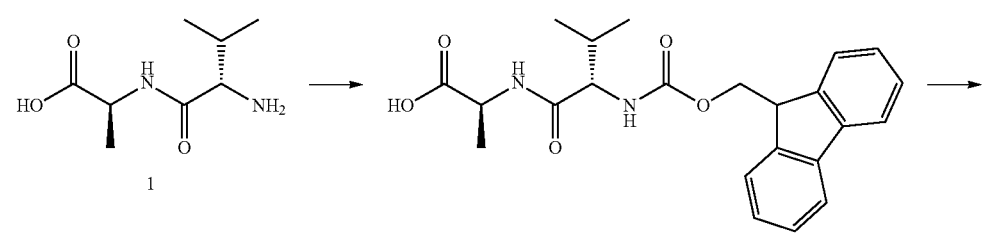

1

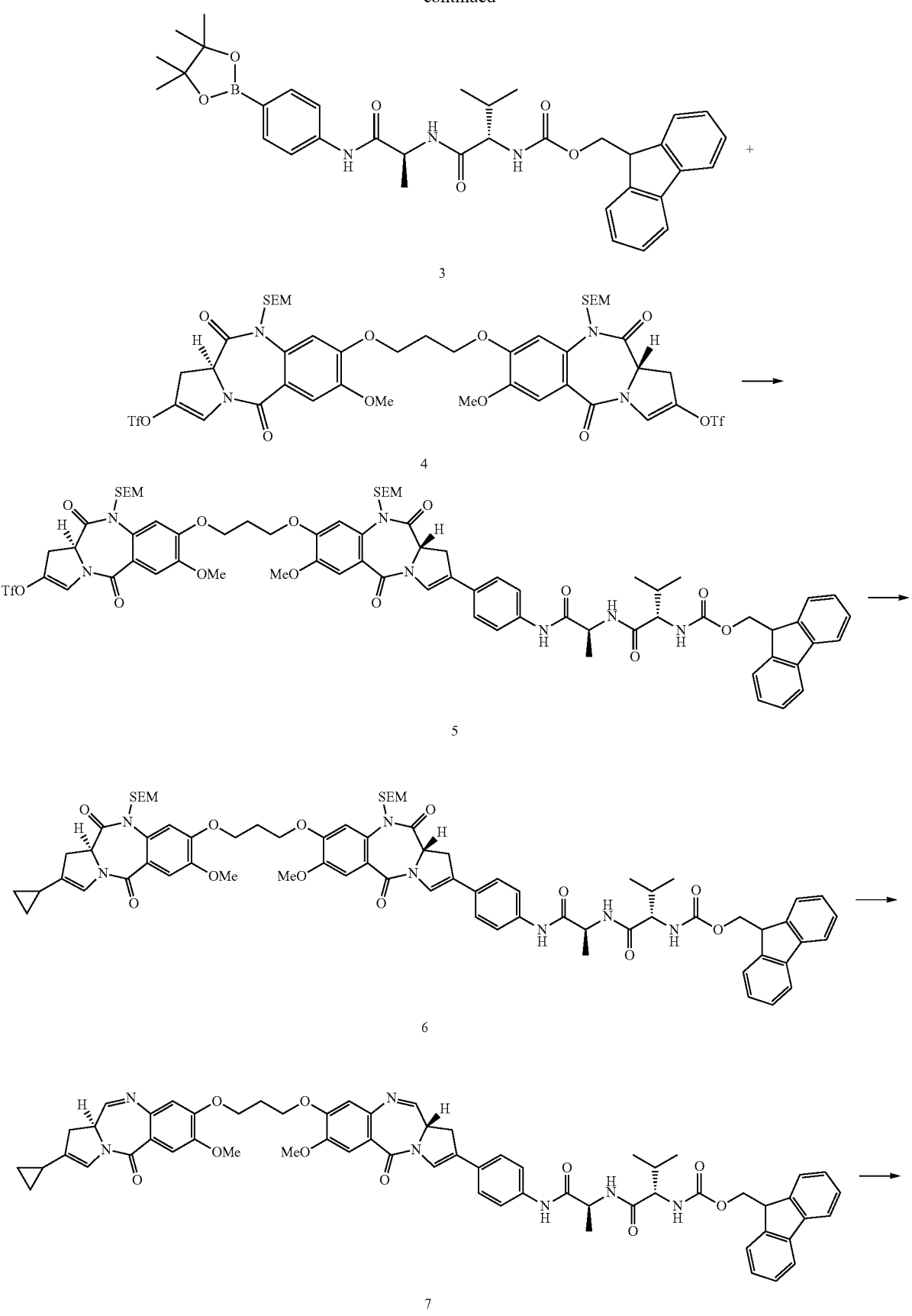

-continued
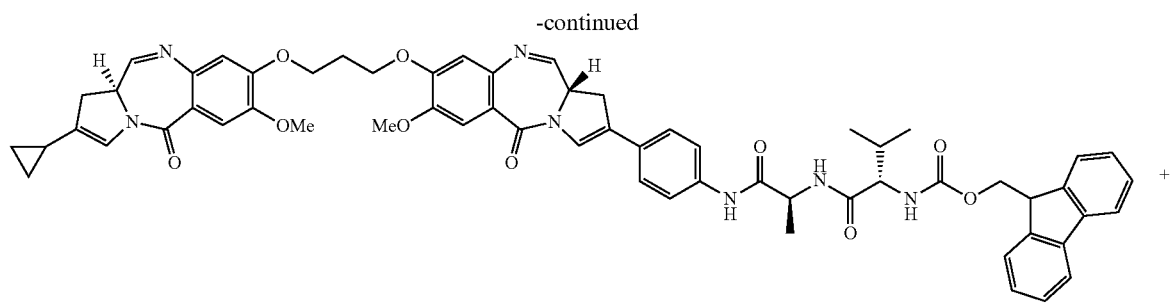
7
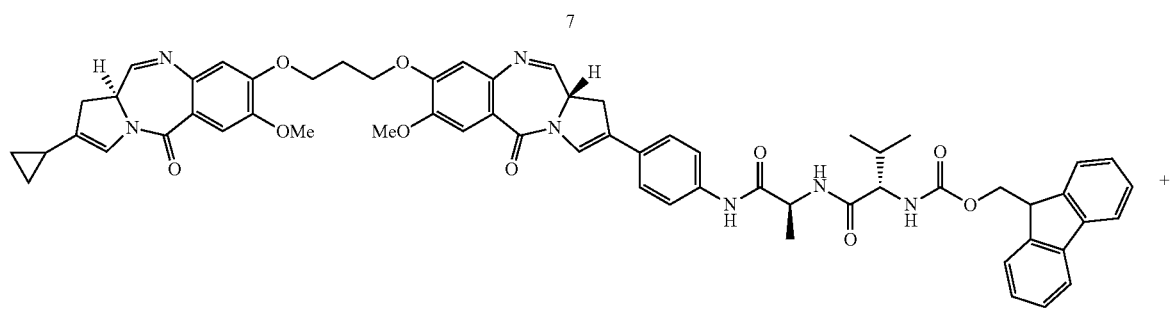
8
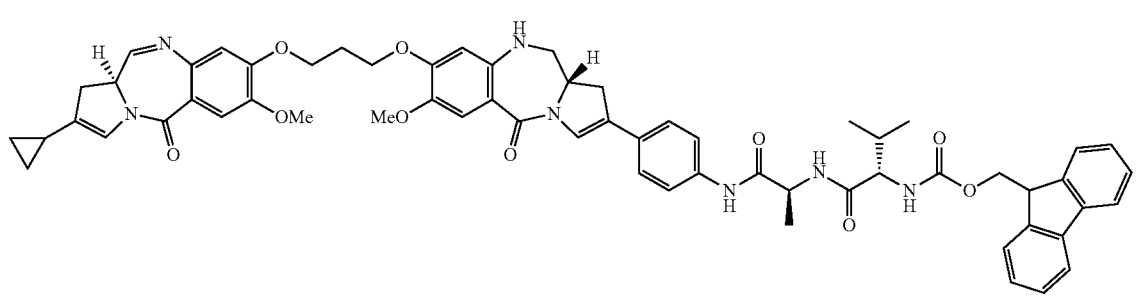
9
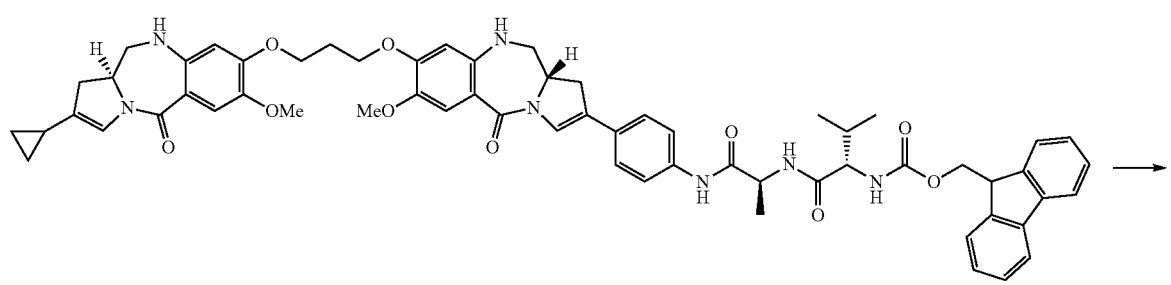
10
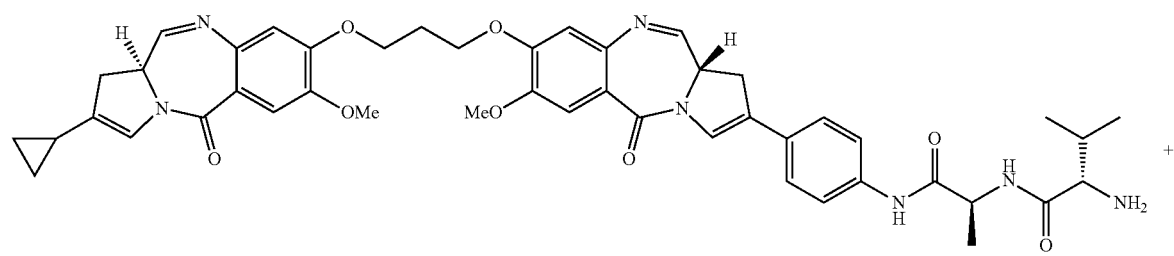
11

-continued

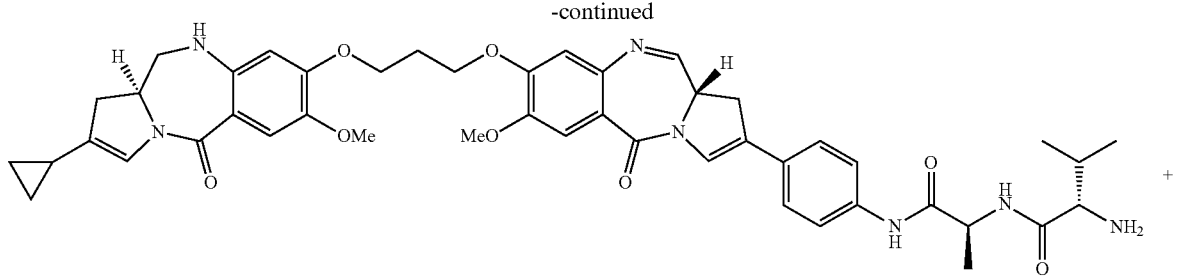

12

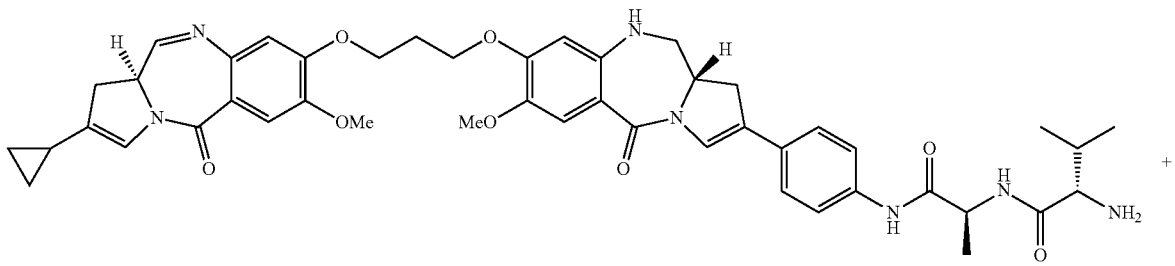

13

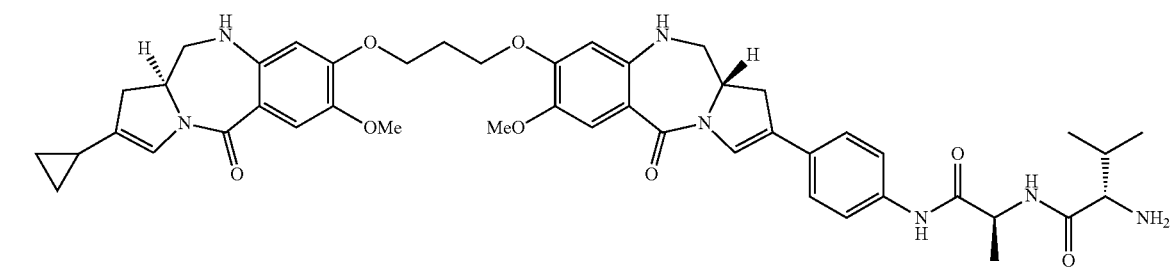

14

(a) (R)-2-((R)-2-((((9H-fluoren-9-yl)methoxy)carbonyl)amino)-3-methylbutanamido) propanoic acid (2)

HO-Ala-Val-H 1 (350 mg, 1.86 mmol) and Na$_2$CO$_3$ (493 mg, 4.65 mmol) were dissolved in distilled H$_2$O (15 mL) and the mixture was cooled to 0° C. before dioxane (15 mL) was added (partial precipitation of the amino acid salt occurred). A solution of Fmoc-Cl (504 mg, 1.95 mmol) in dioxane (15 mL) was added dropwise with vigorous stirring over 10 minutes. The resulting mixture was stirred at 0° C. for 2 hours before the ice bath was removed and stirring was maintained for 16 hours. The solvent was removed by rotary evaporation under reduced pressure and the residue dissolved in water (150 mL). The pH was adjusted from 9 to 2 with 1N HCl and the aqueous layer was subsequently extracted with EtOAc (3×100 mL). The combined organics were washed with brine (100 mL), dried with MgSO$_4$, filtered and the volatiles removed by rotary evaporation under reduced pressure to afford pure HO-Ala-Val-Fmoc 2 (746 mg, 97% yield). LC/MS 2.85 min (ES+) m/z (relative intensity) 410.60; $^1$H-NMR (400 MHz, CDCl$_3$) δ 7.79 (d, J=7.77 Hz, 2H), 7.60 (d, J=7.77 Hz, 2H), 7.43 (d, J=7.5 Hz, 2H), 7.34 (d, J=7.5 Hz, 2H), 6.30 (bs, 1H), 5.30 (bs, 1H), 4.71-7.56 (m, 1H), 4.54-4.36 (m, 2H), 4.08-3.91 (m, 1H), 2.21-2.07 (m, 1H), 1.50 (d, J=7.1 Hz, 3H), 1.06-0.90 (m, 6H).

(b) (9H-fluoren-9-yl)methyl ((S)-3-methyl-1-oxo-1-(((S)-1-oxo-1-((4-(4,4,5,5-tetramethyl-1,3,2-dioxaborolan-2-yl)phenyl)amino)propan-2-yl)amino)butan-2-yl)carbamate (3)

4-Aminophenylboronic acid pinacol ester was added (146.9 mg, 0.67 mmol) was added to a solution of HO-Ala-Val-Fmoc 2 (330 mg, 0.8 mmol), DCC (166 mg, 0.8 mmol) and DMAP (5 mg, cat.) in dry DCM (8 mL) previously stirred for 30 minutes at room temperature in a flask flushed with argon. The reaction mixture was then allowed to stir at room temperature overnight. The reaction was followed by LCMS and TLC. The reaction mixture was diluted with CH$_2$Cl$_2$ and the organics were washed with H$_2$O and brine before being dried with MgSO$_4$, filtered and the solvent removed by rotary evaporation under reduced pressure. The crude product was dryloaded on a silicagel chromatography column (Hexane/EtOAc, 6:4) and pure product 3 was isolated as a white solid in 88% yield (360 mg).

(c) 8-(3-((2-(4-((S)-2-((S)-2-((((9H-fluoren-9-yl) methoxy)carbonyl)amino)-3-methylbutanamido) propanamido)phenyl)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)propoxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl trifluoromethanesulfonate (5)

1,1'-[[(Propane-1,3-diyl)dioxy]bis(11aS)-7-methoxy-2-[[(trifluoromethyl)sulfonyl]oxy]-10-((2-(trimethylsilyl) ethoxy)methyl)-1,10,11,11a-tetrahydro-5H-pyrrolo[2,1-c] [1,4]-benzodiazepin-5,11-dione] 4 (2.03 g, 1.81 mmol), boronic pinacol ester (1 g, 1.63 mmol) and Na$_2$CO$_3$ (881 mg, 8.31 mmol) were dissolved in a mixture of toluene/MeOH/ H$_2$O, 2:1:1 (40 mL). The reaction flask was purged and filled with argon three times before tetrakis(triphenylphosphine) palladium(0) (41 mg, 0.035 mmol) was added and the reaction mixture heated to 30° C. overnight. The solvents were removed under reduce pressure and the residue was taken up in H$_2$O (100 mL) and extracted with EtOAc (3×100 mL). The combined organics were washed with brine (100 mL), dried with MgSO$_4$, filtered and the volatiles removed by rotary evaporation under reduced pressure. The crude product was purified by silica gel chromatography column (Hexane/EtOAc, 8:2 to 25:75) to afford pure 5 in 33% yield (885 mg). LC/MS 3.85 min (ES+) m/z (relative intensity) 1452.90; $^1$H NMR (400 MHz, CDCl$_3$) δ 7.78-7.16 (m, 17H), 7.13 (s, 1H), 6.51-6.24 (m, 1H), 5.51 (dd, J=10.0, 5.1 Hz, 2H), 5.36-5.11 (m, 1H), 4.74 (dd, J=10.1, 4.4 Hz, 2H), 4.70-4.53 (m, 2H), 4.47 (d, J=6.4 Hz, 1H), 4.37 (d, J=7.2 Hz, 1H), 4.27 (m, 4H), 4.20-4.14 (m, 1H), 3.90 (s, 3H), 3.89 (s, 3H), 3.77 (ddd, J=16.7, 9.0, 6.4 Hz, 3H), 3.71-3.61 (m, 2H), 3.24-2.91 (m, 3H), 2.55-2.33 (m, 2H), 2.22-2.07 (m, 1H), 1.52-1.37 (m, 3H), 1.04-0.86 (m, 10H), 0.00 (s, 18H).

(d) (9H-fluoren-9-yl)methyl((2S)-1-(((2S)-1-((4-(8-(3-((2-cyclopropyl-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-8-yl) oxy)propoxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl)phenyl)amino)-1-oxopropan-2-yl)amino)-3-methyl-1-oxobutan-2-yl)carbamate (6)

Triphenylarsine (42 mg, 0.137 mmol) was added to a mixture of PBD-triflate 5 (250 mg, 0.172 mmol), cyclopropylboronic acid (73.9 mg, 0.86 mmol), silver oxide (159 mg, 0.688 mmol) and potassium phosphate tribasic (438 mg, 2.06 mmol) in dry dioxane (10 mL) under an argon atmosphere. The reaction was flushed with argon 3 times and bis(benzonitrile)palladium(II) chloride (13.2 mg, 0.034 mmol) was added. The reaction was flushed with Argon 3 more times before being warmed to 75° C. and stirred for 10 minutes. The reaction mixture was filtered through a pad of celite which was subsequently rinsed with ethyl acetate. The solvent was removed by rotary evaporation under reduced pressure. The resulting residue was subjected to flash column chromatography (silica gel; 1% methanol/chloroform). Pure fractions were collected and combined, and excess eluent was removed by rotary evaporation under reduced pressure to afford the desired product 22 (132 mg, 50% yield). LC/MS 3.83 min (ES+) m/z (relative intensity) 1345.91; $^1$H NMR (400 MHz, CDCl$_3$) δ 7.88-7.14 (m, 17H), 6.69 (s, 1H), 6.45-6.25 (m, 1H), 5.57-5.41 (m, 2H), 5.34- 5.14 (m, 1H), 4.78-4.67 (m, 2H), 4.62-4.55 (m, 1H), 4.50-4.45 (m, 2H), 4.51-4.44 (m, 1H), 4.31-4.21 (m, 4H), 4.16 (m, 1H), 3.92 (s, 3H), 3.86 (s, 3H), 3.82-3.71 (m, 2H), 3.66 (m, 3H), 3.40-3.28 (m, 1H), 3.07 (m, 1H), 2.70-2.57 (m, 1H), 2.47-2.36 (m, 2H), 2.15 (m, 1H), 1.51-1.40 (m, 3H), 1.03-0.87 (m, 11H), 0.77-0.71 (m, 2H), 0.60-0.54 (m, 2H), 0.00 (t, J=3.0 Hz, 18H).

(e) (9H-fluoren-9-yl)methyl((2S)-1-(((2S)-1-((4-(8-(3-((2-cyclopropyl-7-methoxy-5-oxo-5,11a-dihydro-1H-benzo[e]pyrrolo[1,2-a][1,4]diazepin-8-yl)oxy) propoxy)-7-methoxy-5-oxo-5,11a-dihydro-1H-benzo [e]pyrrolo[1,2-a][1,4]diazepin-2-yl)phenyl)amino)-1-oxopropan-2-yl)amino)-3-methyl-1-oxobutan-2-yl) carbamate (7)

A solution of Super-Hydride® (0.5 mL, 1M in THF) was added dropwise to a solution of SEM dilactam 6 (265 mg g, 0.19 mmol) in THF (10 mL) at −78° C. under an argon atmosphere. The addition was completed over 5 minutes in order to maintain the internal temperature of the reaction mixture constant. After 20 minutes, an aliquot was quenched with water for LC/MS analysis, which revealed that the reaction was complete. Water (20 mL) was added to the reaction mixture and the cold bath was removed. The organic layer was extracted with EtOAc (3×30 mL) and the combined organics were washed with brine (50 mL), dried with MgSO$_4$, filtered and the solvent removed by rotary evaporation under reduced pressure. The crude product was dissolved in MeOH (12 mL), CH$_2$Cl$_2$ (6 mL), water (2 mL) and enough silica gel to form a thick stirring suspension. After 5 days, the suspension was filtered through a sintered funnel and washed with CH$_2$Cl$_2$/MeOH (9:1) (200 mL) until the elution of the product was complete. The organic layer was washed with brine (2×70 mL), dried with MgSO$_4$, filtered and the solvent removed by rotary evaporation under reduced pressure. Purification by silica gel column chromatography (100% CHCl$_3$ to 96% CHCl$_3$/4% MeOH) afforded the product 23 as a yellow solid (162 mg, 78%). LC/MS 3.02 min (ES+) m/z (relative intensity) 1052.37.

(f) Imine Reduction

A solution of Super-Hydride® (95 μL, 1 eq, 1M in THF) was added dropwise to a solution of bis imine 7 (100 mg, 0.095 mmol) in THF (10 mL) at −78° C. under an argon atmosphere. After 20 minutes, an aliquot was quenched with water for LC/MS analysis, which revealed that the reaction was complete, with some over-reduction towards the bis amine 10. (Observed LC: Bis-imine 7 19%, Imine-Amine 8+9 36%, bis-amine 10 45%; theoretical target for 1 eq of reducing agent is 7 25%, 8+9 50%, 10 25%). Water (20 mL) was added to the reaction mixture and the cold bath was removed. The organic layer was extracted with chloroform (40 mL) and the combined organics were washed with water (1×40 mL), brine (50 mL), dried with Na$_2$SO$_4$, filtered and the solvent removed by rotary evaporation under reduced pressure. Purification by silica gel column chromatography (100% CHCl$_3$ to 96% CHCl$_3$/4% MeOH) improved the ratio of 8+9 to: 7 25%, 8+9 50%, 10 25% (20 mg, 25%, as a mixture).

LC/MS (Fast Formic, 2.5 min system) Bis-Imine 7 1.66 min (ES+) m/z (relative intensity) 1052.15; Hybrids Amine-Imine 8+9 (no separation on the 2.5 min system) 1.71 min (ES+) m/z (relative intensity) 1054.45; Bis-Amine 10 1.66 min (ES+) m/z (relative intensity) 1056.95, in a 1/2/1 ratio.

(g) Fmoc Deprotection

Excess piperidine was added (0.1 mL, 1 mmol) to a 1/2/1 mixture of Fmoc protected 7, 8+9 and 10 (20 mg, 0.019 mmol) in DMF (1 mL). The mixture was allowed to stir at room temperature for 20 minutes, at which point the reaction had gone to completion (as monitored by LC/MS). The reaction mixture was diluted with $CH_2Cl_2$ (30 mL) and the organic phase was washed with $H_2O$ (2×30 mL) until complete piperidine removal. The organic phase was dried over $MgSO_4$, filtered and excess solvent removed by rotary evaporation under reduced pressure to afford crude products 11, 12+13 and 14 (1/2/1 ratio), which were used as such in the next step.

LC/MS (Fast Formic, 2.5 min system) Bis-Imine 11 1.12 min (ES+) m/z (relative intensity) 830.45; Hybrids Amine-Imine 12+13 (no separation) 1.15 min (ES+) m/z (relative intensity) 832.35; Bis-Amine 14 1.19 min (ES+) m/z (relative intensity) 834.35, in a 1/2/1 ratio.

Example 2

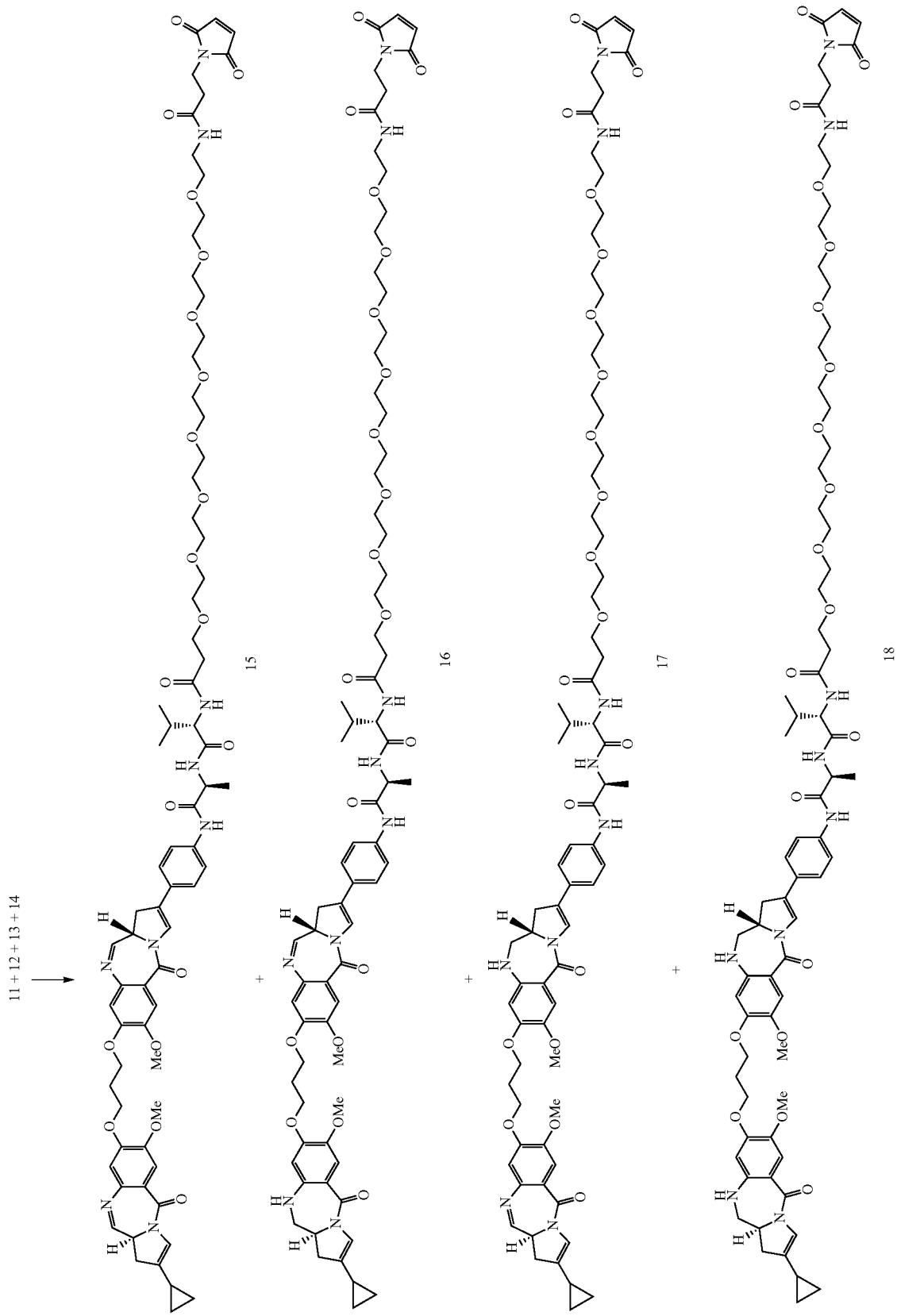

PEG Maleimide Coupling

EDCl hydrochloride (5.46 mg, 0.028 mmol, 1.5 eq) was added to a suspension of Maleimide-PEG$_8$-acid (11.3 mg, 0.019 mmol, 1 eq) in chloroform (5 mL) under argon atmosphere. The mixture was stirred for 1 h at room temperature before crude PBD mixture 11+12+13+14 (20 mg, 0.019 mmol, 1 eq) was added. Stirring was maintained until the reaction was complete (usually 2 hours). The reaction was diluted with CH$_2$Cl$_2$ and the organic phase was washed with H$_2$O and brine before being dried over MgSO$_4$, filtered and excess solvent removed by rotary evaporation under reduced pressure. The four products were purified and separated individually by reverse phase chromatography (see method below). The bis-imine 15 was isolated (2.0 mg, 7.5%), followed by the two separable amine-imine hybrids 16 (3.8 mg, 14.2%) and 17 (2.7 mg, 10.1%), and the bis-amine 18 (2.2 mg, 8.2%). $^1$H NMR analysis unambiguously identified 16 from 17. One key feature is the imine proton (d, J=4.0 Hz, 1H), which is at 7.78 ppm on the cyclopropyl side, and 7.88 ppm on the aromatic side of the molecule.

LC/MS C18 15 min formic:

Bis-Imine 15 5.23 min (ES+) m/z (relative intensity) 703.20 (100, (M+2H)/2), 1404.55 (10, M+H); $^1$H NMR (400 MHz, CDCl$_3$) δ 8.96 (s, 1H), 7.89 (d, J=4.0 Hz, 1H), 7.78 (d, J=4.0 Hz, 1H), 7.77-7.64 (m, 2H), 7.53-7.47 (m, 2H), 7.44 (s, 1H), 7.33 (d, J=8.7 Hz, 2H), 7.12 (s, 1H), 6.89-6.81 (m, 2H), 6.74 (s, 1H), 6.69 (d, J=1.6 Hz, 2H), 6.50 (s, 1H), 4.72-4.57 (m, 1H), 4.43-4.14 (m, 7H), 4.11-4.03 (m, 1H), 3.93 (d, J=4.6 Hz, 6H), 3.83 (t, J=7.2 Hz, 2H), 3.80-3.71 (m, 2H), 3.68-3.56 (m, 28H), 3.55-3.48 (m, 3H), 3.44-3.34 (m, 3H), 3.16-3.04 (m, 1H), 2.95-2.84 (m, 1H), 2.58-2.47 (m, 4H), 2.47-2.37 (m, 2H), 2.33-2.16 (m, 1H), 1.51-1.41 (m, 4H), 1.05-0.94 (m, 6H), 0.77 (dt, J=5.5, 4.8 Hz, 2H), 0.55 (dd, J=9.3, 4.9 Hz, 2H).

Hybrid Amine-Imine 16 5.48 min (ES+) m/z (relative intensity) 704.20 (100, (M+2H)/2), 1406.70 (5, M+H); $^1$H NMR (400 MHz, CDCl$_3$) δ 8.97 (s, 1H), 7.88 (d, J=3.9 Hz, 1H), 7.78-7.64 (m, 2H), 7.55-7.48 (m, 2H), 7.43 (s, 1H), 7.36-7.29 (m, 2H), 7.12 (s, 1H), 6.93-6.80 (m, 3H), 6.69 (d, J=1.7 Hz, 2H), 6.49 (s, 1H), 6.10 (s, 1H), 4.72-4.58 (m, 1H), 4.41-4.32 (m, 1H), 4.32-4.24 (m, 2H), 4.24-4.16 (m, 2H), 4.15-4.02 (m, 2H), 3.94 (s, 3H), 3.87-3.80 (m, 5H), 3.79-3.71 (m, 2H), 3.69-3.55 (m, 28H), 3.55-3.49 (m, 2H), 3.46-3.34 (m, 4H), 2.93-2.81 (m, 2H), 2.60-2.46 (m, 4H), 2.42-2.34 (m, 2H), 2.24 (dd, J=14.0, 6.5 Hz, 2H), 1.52-1.38 (m, 4H), 1.07-0.92 (m, 6H), 0.75-0.66 (m, 2H), 0.53-0.44 (m, 2H).

Hybrid Imine-Amine 17 5.41 min (ES+) m/z (relative intensity) 704.25 (100, (M+2H)/2), 1406.45 (3, M+H); $^1$H NMR (400 MHz, CDCl$_3$) δ 8.90 (s, 1H), 7.78 (d, J=4.0 Hz, 1H), 7.74-7.58 (m, 2H), 7.56 (s, 1H), 7.53-7.49 (m, 2H), 7.36-7.27 (m, 2H), 7.17-7.04 (m, 1H), 6.95-6.86 (m, 1H), 6.83 (s, 1H), 6.74 (s, 1H), 6.71-6.65 (m, 2H), 6.53 (s, 1H), 6.12 (s, 1H), 4.74-4.57 (m, 2H), 4.40-4.14 (m, 7H), 4.13-4.05 (m, 1H), 3.93 (s, 3H), 3.88-3.79 (m, 5H), 3.79-3.68 (m, 2H), 3.69-3.55 (m, 28H), 3.55-3.48 (m, 3H), 3.46-3.29 (m, 3H), 3.16-3.03 (m, 1H), 2.91 (s, 1H), 2.71 (s, 1H), 2.60-2.45 (m, 4H), 2.42-2.33 (m, 2H), 2.29-2.19 (m, 1H), 1.51-1.39 (m, 4H), 1.08-0.92 (m, 6H), 0.81-0.74 (m, 2H), 0.55 (dd, J=9.3, 5.4 Hz, 2H).

Bis-amine 18 5.72 min (ES+) m/z (relative intensity) 705.15 (100, (M+2H)/2), 1408.45 (3, M+H); $^1$H NMR (400 MHz, CDCl$_3$) δ 8.91 (s, 1H), 7.73-7.59 (m, 2H), 7.57-7.49 (m, 3H), 7.29 (d, J=2.5 Hz, 2H), 7.13 (s, 1H), 6.91 (s, 1H), 6.84 (s, 1H), 6.68 (d, J=2.0 Hz, 2H), 6.49 (s, 1H), 6.08 (d, J=3.9 Hz, 3H), 4.72-4.57 (m, 2H), 4.19 (dd, J=10.6, 4.3 Hz, 5H), 4.09 (dd, J=12.6, 5.8 Hz, 2H), 3.88-3.80 (m, 8H), 3.79-3.69 (m, 2H), 3.68-3.56 (m, 28H), 3.54-3.46 (m, 2H), 3.44-3.26 (m, 4H), 2.85 (dd, J=15.9, 10.4 Hz, 2H), 2.73 (dd, J=16.2, 4.7 Hz, 2H), 2.61-2.43 (m, 4H), 2.38-2.16 (m, 5H), 1.51-1.38 (m, 4H), 1.05-0.93 (m, 6H), 0.69 (dt, J=4.9, 4.3 Hz, 2H), 0.49 (dd, J=5.1, 3.3 Hz, 2H).

Example 3

(a) tert-butyl (11S)-2-(4-((S)-2-((S)-2-((((9H-fluoren-9-yl)methoxy)carbonyl)amino)-3-methylbutanamido)propanamido)phenyl)-11-((tert-butyldimethylsilyl)oxy)-8-hydroxy-7-methoxy-5-oxo-11,11a-dihydro-1H-benzo[e]pyrrolo[1,2-a][1,4]diazepine-10(5H)-carboxylate (27)

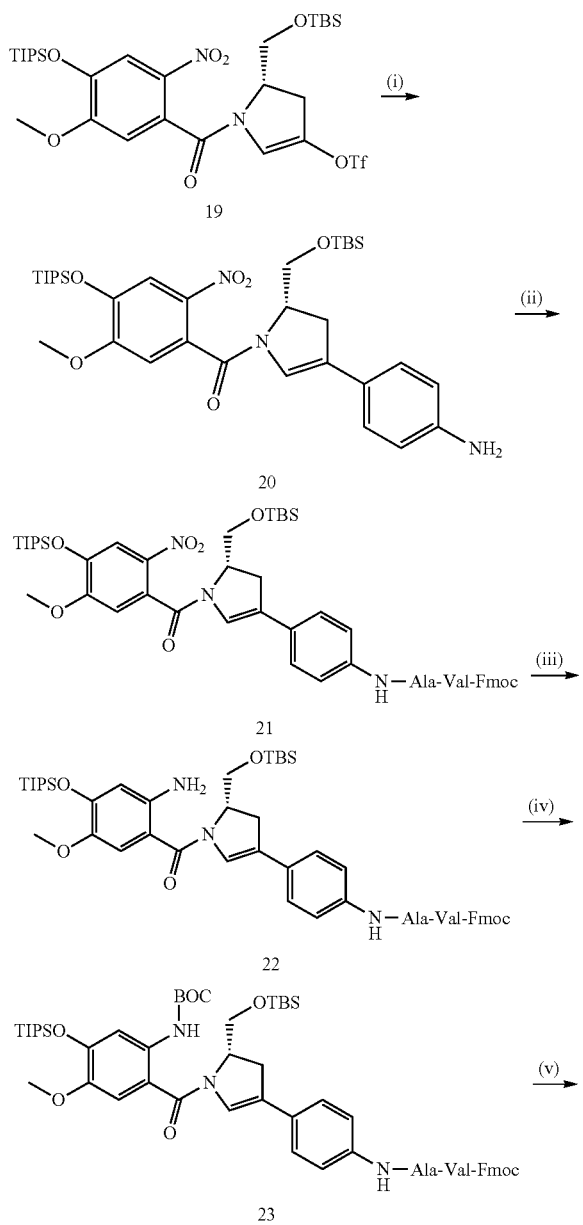

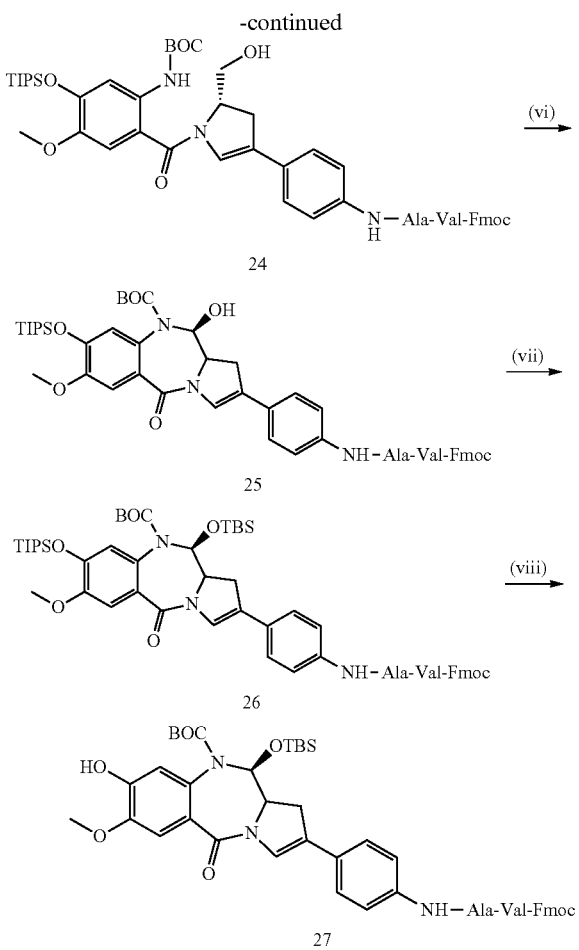

(i) (S)-(4-(4-aminophenyl)-2-(((tert-butyldimethylsilyl)oxy)methyl)-2,3-dihydro-1H-pyrrol-1-yl)(5-methoxy-2-nitro-4-((triisopropylsilyl)oxy)phenyl) methanone (20)

Pd(PPh₃)₄ (609 mg, 0.52 mmol) was added to a stirred mixture of triflate 19 (18.8 g, 26.3 mmol), 4-aminophenylboronic acid pinacol ester (8.64 g, 39.4 mmol), Na₂CO₃ (12.78 g, 120 mmol), MeOH (80 mL), toluene (160 mL) and water (80 mL). The reaction mixture was allowed to stir at 30° C. under a nitrogen atmosphere for 24 hours after which time all the boronic ester has consumed. The reaction mixture was then evaporated to dryness before the residue was taken up in EtOAc (100 mL) and washed with H₂O (100 mL), brine (100 mL), dried (MgSO₄), filtered and evaporated under reduced pressure to provide the crude product. Purification by silica gel chromatography (Hexane/EtOAc; 100% to 70:30) afforded product 20 as a yellowish foam (11.06 g, 64%). ¹H-NMR (400 MHz, CDCl₃) δ 7.74 (s, 1H), 7.00 (d, J=8.3 Hz, 2H), 6.81 (s, 1H), 6.58 (d, J=8.3 Hz, 2H), 6.06 (s, 1H), 4.77 (bm, 1H), 3.91 (d, J=6.7 Hz, 3H), 3.68 (bs, 2H), 3.13 (bm, 1H), 2.97 (d, J=14.5 Hz, 1H), 1.36-1.21 (m, 3H), 1.12 (d, J=7.3 Hz, 18H), 0.89 (s, 10H), 0.10 (s, 6H).); ES⁺=2.27 min, m/z 698 [M+CH₃CN]⁺.

(ii) (9H-fluoren-9-yl)methyl ((S)-1-(((S)-1-((4-((S)-5-(((tert-butyldimethylsilyl)oxy)methyl)-1-(5-methoxy-2-nitro-4-((triisopropylsilyl)oxy)benzoyl)-4,5-dihydro-1H-pyrrol-3-yl)phenyl)amino)-1-oxopropan-2-yl)amino)-3-methyl-1-oxobutan-2-yl) carbamate (21)

To a dry round bottom flask previously flushed with argon was added aniline 20 (10.05 g, 15.3 mmol), the dipeptide (6.3 g, 15.3 mmol) and dry CH₂Cl₂ (500 mL). The flask was then purged three times with argon before EEDQ (3.79 g, 15.3 mmol) was added and the mixture left to stir at room temperature. The reaction was followed by LCMS and after 3.5 hours the reaction was complete. The reaction was quenched with H₂O (200 mL) and extracted twice with CH₂Cl₂ (250 mL). The combined organics were washed with brine (150 mL), dried over MgSO₄, filtered and the solvent removed in vacuo. The crude product was purified by silica gel chromatography (Hexane/EtOAc; 100% to 55:45) to afford pure product 21 (13.821 g, 86%). ¹H-NMR (400 MHz, CDCl₃) δ 8.26 (s, 1H), 7.64 (s+d, J=4.9 Hz, 3H), 7.43 (t, J=7.3 Hz, 1H), 7.36 (d, J=7.3 Hz, 1H), 7.28 (t, J=7.3 Hz, 1H), 7.19 (d, J=7.7 Hz, 1H), 6.99 (d, J=7.9 Hz, 1H), 6.71 (s, 1H), 6.27 (d, J=6.3 Hz, 1H), 6.08 (s, 1H), 5.11 (d, J=6.6 Hz, 1H), 4.69 (bs, 1H), 4.52 (bm, 1H), 4.36 (d, J=6.5 Hz, 2H), 4.08 (t, J=5.9 Hz, 1H), 3.89 (m, 1H), 3.80 (s, 3H), 3.11-2.97 (bm, 1H), 2.88 (bd, J=15.2 Hz, 1H), 2.03 (bs, 1H), 1.33 (d, J=6.9 Hz, 3H), 1.24-1.11 (m, 3H), 1.01 (d, J=7.4 Hz, 18H), 0.86-0.79 (m, 6H), 0.77 (s, 9H), 0.00 (s, 6H); ES⁺=2.37 min, no mass.

(iii) (9H-fluoren-9-yl)methyl ((S)-1-(((S)-1-((4-((S)-1-(2-amino-5-methoxy-4-((triisopropylsilyl)oxy) benzoyl)-5-(((tert-butyldimethylsilyl)oxy)methyl)-4,5-dihydro-1H-pyrrol-3-yl)phenyl)amino)-1-oxopropan-2-yl)amino)-3-methyl-1-oxobutan-2-yl) carbamate (22)

In a dry two-neck round bottom flask previously flushed with argon and fitted with a thermometer, nitrophenyl 21 (2.97 g, 2.8 mmol) was solubilised in a solution of 5% formic acid in methanol (50 mL). Zinc (1.85 g, 28 mmol) was rapidly poured into the solution. The temperature instantaneously rose to 40° C. and slowly cooled down back to room temperature at which point the reaction is complete (≈15 minutes, reaction monitored by LCMS). The reaction mixture was then filtered through celite and the pad further washed with EtOAc (2×150 mL). The combined organics were subsequently washed with saturated NaHCO₃ (aq) (100 mL), H₂O (100 mL) and brine (100 mL), before being dried over MgSO₄, filtered and the volatiles removed in vacuo. The crude material was purified silica gel chromatography (Hexane/EtOAC 75:25 to 50:50) and pure product 22 was isolated as a pale yellow oil (2.291 g, 79% yield). ¹H-NMR (400 MHz, CDCl₃) δ 8.37 (s, 1H), 7.74 (s+d, J=4.9 Hz, 3H), 7.53 (t, J=7.4 Hz, 2H), 7.46 (d, J=11.3 Hz, 2H), 7.39 (t, J=7.3 Hz, 2H), 7.28 (t, J=11.3 Hz, 2H), 7.09 (d, J=7.9 Hz, 2H), 6.38 (d, J=6.3 Hz, 1H), 6.18 (s, 1H), 5.21 (d, J=2.9 Hz, 1H), 4.81 (bs, 1H), 4.72-4.57 (m, 1H), 4.47 (d, J=6.5 Hz, 2H), 4.19 (t, J=5.0 Hz, 1H), 4.00-3.94 (m, 1H), 3.91 (s, 3H), 3.23-3.07 (m, 1H), 2.98 (d, J=16.8 Hz, 1H), 2.15 (s, 1H), 1.43 (d, J=6.9 Hz, 3H), 1.36-1.18 (m, 3H), 1.12 (d, J=7.4 Hz, 18H), 0.97-0.89 (m, 6H), 0.88 (s, 9H), 0.10 (s, 6H). ES⁺=2.37 min, m/z no mass (iv) (9H-fluoren-9-yl)methyl ((S)-1-(((S)-1-((4-((S)-1-(2-((tert-butoxycarbonyl)amino)-5-methoxy-4-((triisopropylsilyl)oxy)benzoyl)-5-(((tert-butyldimethylsilyl)oxy)methyl)-4,5-dihydro-1H-pyrrol-3-yl)phenyl)amino)-1-oxopropan-2-yl)amino)-3-methyl-1-oxobutan-2-yl)carbamate (23)

Amine 22 (14.913 g, 14.6 mmol) and Boc$_2$O (3.83 g, 17.5 mmol) were heated together at 70° C. in a round bottom flask. To help with solubility, CHCl$_3$ (25 mL) was added and the mixture left to stir until the reaction was complete (followed by LCMS). The thick crude solution was left to cool down to room temperature before being directly loaded on a silica gel chromatography column (Hexane/EtOAc; 100% to 65:35). Product 23 was isolated as a cream foam (13.2 g, 80% yield). $^1$H-NMR (400 MHz, CDCl$_3$) δ 8.40 (s, 1H), 8.21 (s, 1H), 7.74 (d, J=7.8 Hz, 3H), 7.54 (t, J=7.0 Hz, 2H), 7.48 (d, J=7.7 Hz, 2H), 7.38 (t, J=7.4 Hz, 2H), 7.31-7.25 (m, 3H), 7.14 (d, J=6.7 Hz, 2H), 6.84 (bs, 1H), 6.80 (s, 1H), 6.50 (d, J=6.4 Hz, 1H), 5.28 (d, J=6.0 Hz, 1H), 4.77 (d, J=2.6 Hz, 1H), 4.70-4.58 (m, 1H), 4.47 (t, J=5.7 Hz, 2H), 4.19 (t, J=6.1 Hz, 1H), 4.00 (m, 2H), 3.88 (bs, 1H), 3.73 (s, 3H), 3.05 (m, 1H), 2.98 (dd, J=15.4, 3.3 Hz, 1H), 2.15 (bm, 1H), 1.46 (s, 9H), 1.43 (d, J=11.7 Hz, 3H), 1.36-1.22 (m, 3H), 1.12 (d, J=7.4 Hz, 18H), 1.00-0.89 (m, 6H), 0.84 (s, 9H), 0.05 (d, J=6.0 Hz, 6H)); ES$^+$=2.53 min, no mass.

(v) (9H-fluoren-9-yl)methyl ((S)-1-(((S)-1-((4-((S)-1-(2-((tert-butoxycarbonyl)amino)-5-methoxy-4-((triisopropylsilyl)oxy)benzoyl)-5-(hydroxymethyl)-4,5-dihydro-1H-pyrrol-3-yl)phenyl)amino)-1-oxopropan-2-yl)amino)-3-methyl-1-oxobutan-2-yl)carbamate (24)

Silyl ether 23 (13.2 g, 11.8 mmol) was solubilised in a 7:2:1:1 mixture of AcOH/H$_2$O/MeOH/THF (220 mL) and the mixture was stirred at room temperature until the reaction was complete (left overnight). The volatiles were removed in vacuo and the residue was taken up in EtOAc (400 mL). The organic phase was washed with saturated NaHCO$_{3(aq)}$ (200 mL), H$_2$O (200 mL) and brine (10 mL) before being dried over MgSO$_4$, filtered and concentrated in vacuo. The crude material was purified by silica gel chromatography (Hex/EtOAc; 50:50 to 0:100) and pure product 24 was isolated as a light yellow foam (11.168 g, 94% yield). $^1$H-NMR (400 MHz, CDCl$_3$) δ 8.45 (s, 1H), 7.93 (s, 1H), 7.74 (d, J=7.4 Hz, 2H), 7.64 (s, 1H), 7.52 (dd, J=17.9, 8.9 Hz, 4H), 7.39 (t, J=7.4 Hz, 2H), 7.33-7.26 (m, 3H), 7.13 (d, J=7.4 Hz, 2H), 6.81 (s, 1H), 6.45 (s, 1H), 5.26 (s, 1H), 4.84 (s, 1H), 4.69-4.58 (m, 1H), 4.47 (d, J=6.2 Hz, 2H), 4.43 (s, 1H), 4.17 (d, J=14.2 Hz, 1H), 3.99 (s, 1H), 3.89 (s, 2H), 3.74 (s, 3H), 3.30-3.17 (m, 1H), 2.64 (d, J=16.9 Hz, 1H), 2.23-2.09 (m, 1H), 1.44 (s, 9H), 1.44 (d, J=10.9 Hz, 2H), 1.29 (ddd, J=14.3, 13.0, 7.4 Hz, 3H), 1.12 (d, J=7.4 Hz, 18H), 0.92 (m, 6H); ES$^+$=2.23 min, no mass (vi) tert-butyl (11S)-2-(4-((S)-2-((S)-2-((((9H-fluoren-9-yl)methoxy)carbonyl)amino)-3-methylbutanamido)propanamido)phenyl)-11-hydroxy-7-methoxy-5-oxo-8-((triisopropylsilyl)oxy)-11,11a-dihydro-1H-benzo[e]pyrrolo[1,2-a][1,4]diazepine-10(5H)-carboxylate (25)

DMSO (1.55 L, 21.9 mmol) was added to a cooled solution of oxallyl chloride (0.89 mL, 10.5 mmol) in CH$_2$Cl$_2$ (50 mL) at −78° C. After 15 minutes, a solution of alcohol 24 (8.8 mg, 8.76 mmol) in CH$_2$Cl$_2$ (100 mL) was added dropwise to the oxidising mixture. The reaction was left to stir at −78° C. for 1 hour before NEt$_3$ (6.11 mL, 43.8 mmol) was added and the mixture allowed to warm to room temperature. Upon completion, the reaction mixture was diluted with CH$_2$Cl$_2$ (100 mL) and the solution was washed with 0.1M HCl(aq.) (250 mL), H$_2$O (250 mL), saturated NaHCO$_{3(aq.)}$ (250 mL) and brine (200 mL). The organics were dried with MgSO$_4$, filtered and the volatiles removed in vacuo. The crude material was purified by silica gel chromatography (CH$_2$Cl$_2$/EtOAc; 100% to 50:50) to provide pure 25 as a yellow oil (8.8 mg, 100%). $^1$H-NMR (400 MHz, CDCl$_3$) δ 8.71 (s, 1H), 7.74 (t, J=8.4 Hz, 3H), 7.52 (d, J=7.4 Hz, 5H), 7.43-7.33 (m, 4H), 7.23-7.17 (m, 2H), 6.69 (s, 1H), 6.42 (d, J=7.9 Hz, 1H), 5.78 (d, J=7.8 Hz, 1H), 5.62 (s, 1H), 5.23 (d, J=7.7 Hz, 1H), 4.84-4.69 (m, 1H), 4.65 (d, J=22.5 Hz, 1H), 4.45-4.29 (m, 2H), 3.91 (dd, J=11.3, 8.1 Hz, 1H), 3.86 (s, 3H), 3.28 (q, J=11.9 Hz, 1H), 2.98 (t, J=12.6 Hz, 1H), 2.14 (dd, J=12.9, 10.0 Hz, 1H), 1.52-1.42 (m, 3H), 1.38 (s, 9H), 1.26 (m, 3H), 1.16-1.05 (m, 18H), 0.93 (d, J=6.0 Hz, 6H); ES$^+$=2.19 min, no mass.

(vii) tert-butyl (11S)-2-(4-((S)-2-((S)-2-((((9H-fluoren-9-yl)methoxy)carbonyl)amino)-3-methylbutanamido)propanamido)phenyl)-11-((tert-butyldimethylsilyl)oxy)-7-methoxy-5-oxo-8-((triisopropylsilyl)oxy)-11,11a-dihydro-1H-benzo[e]pyrrolo[1,2-a][1,4]diazepine-10(5H)-carboxylate (26)

Alcohol 25 (8.8 g, 8.78 mmol) was solubilised in dry CH$_2$Cl$_2$ (150 mL) in a sealed round bottom flask previously flushed three times with argon. The solution was cooled to 0° C. before lutidine (4 mL, 35.1 mmol) and TBS-OTf (6 mL, 26.3 mmol) were subsequently added. The reaction mixture was left to warm to room temperature and stirred until complete (monitored by LCMS). Upon completion, the solution was diluted with CH$_2$Cl$_2$ (100 mL), washed with saturated NH$_4$Cl$_{(aq.)}$ (150 mL), H$_2$O (100 mL), saturated NaHCO$_3$(aq.) (100 mL) and brine (100 mL). The organics were dried with MgSO$_4$, filtered and the volatiles removed in vacuo. The crude material was purified by silica gel chromatography (Hexane/EtOAc: 100% to 80:20) to provide pure 26 as a colourless oil (6.18 mg, 70%). $^1$H-NMR (400 MHz, CDCl$_3$) δ 8.40 (s, 1H), 7.76 (d, J=7.5 Hz, 2H), 7.55 (dd, J=13.0, 6.7 Hz, 4H), 7.40 (t, J=7.3 Hz, 4H), 7.33-7.27 (m, 3H), 7.21 (s, 1H), 6.67 (s, 1H), 6.49 (s, 1H), 5.87 (d, J=8.8 Hz, 1H), 5.30 (d, J=5.7 Hz, 1H), 4.71-4.59 (m, 1H), 4.48 (d, J=6.8 Hz, 1H), 4.20 (t, J=6.7 Hz, 1H), 4.04-3.96 (m, 1H), 3.86 (s, 3H), 3.84-3.77 (m, 1H), 3.25 (m, 1H), 2.79 (d, J=1.5 Hz, 1H), 2.26-2.11 (m, 1H), 1.46 (d, J=6.9 Hz, 3H), 1.33 (s, 9H), 1.27 (dd, J=17.1, 9.7 Hz, 3H), 1.11 (dd, J=7.4, 4.0 Hz, 18H), 0.93 (s, 6H), 0.89 (s, 9H), 0.27 (s, 3H), 0.22 (s, 3H); ES$^+$=2.55 min, m/z 116.30 [M+H]$^+$ (viii) tert-butyl (11S)-2-(4-((S)-2-((S)-2-((((9H-fluoren-9-yl)methoxy)carbonyl)amino)-3-methylbutanamido)propanamido)phenyl)-11-((tert-butyldimethylsilyl)oxy)-8-hydroxy-7-methoxy-5-oxo-11,11a-dihydro-1H-benzo[e]pyrrolo[1,2-a][1,4]diazepine-10(5H)-carboxylate (27)

Monomer 26 (1 g, 0.89 mmol) was solubilised in wet DMF (5 mL+0.5 mL H$_2$O) before LiOAc (91 mg, 0.89 mmol) was added and the mixture left to stir at room temperature until complete (≈3 h, followed by LCMS). The mixture was subsequently diluted with EtOAc (50 mL), quenched with citric acid(aq.) (pH=3, 40 mL), then washed with H$_2$O (50 mL) and brine (50 mL). The organic layer was dried over MgSO$_4$, filtered and the volatiles removed in vacuo. The crude product was purified by silica gel chromatography (Hexane/EtOAc/MeOH; 60:40:0 to 60:30:10) and pure product 27 was isolated as a cream solid (675 mg, 78% yield). $^1$H-NMR (400 MHz, CDCl$_3$) δ 8.36 (s, 1H), 7.76 (d, J=7.6 Hz, 2H), 7.55 (dd, J=16.0, 7.5 Hz, 4H), 7.40 (t, J=7.4 Hz, 4H), 7.30 (ddd, J=14.7, 7.4, 1.1 Hz, 3H), 7.24 (s, 1H), 6.72 (s, 1H), 6.38 (d, J=5.3 Hz, 1H), 5.87 (s, 1H), 5.23 (d, J=6.2 Hz, 1H), 4.69-4.57 (m, 1H), 4.49 (d, J=6.6 Hz, 2H), 4.20 (t, J=5.3 Hz, 1H), 4.04-3.96 (m, 1H), 3.96 (s, 3H), 3.87 (dd, J=10.1, 3.5 Hz, 1H), 3.29 (dd, J=18.0, 8.5 Hz, 1H), 2.80 (d, J=19.4 Hz, 1H), 2.24-2.08 (m, 1H), 1.46 (d, J=10.5 Hz, 3H), 1.33 (s, 9H), 1.00-0.91 (m, 6H), 0.90 (s, 9H), 0.25 (d, J=8.6 Hz, 6H); ES$^+$=2.08 min, m/z 960.35 [M+H]$^+$.

(b) (S)-8-((5-iodopentyl)oxy)-7-methoxy-1,2,3,11a-tetrahydro-5H-pyrrolo[2,1-c][1,4]benzodiazepine-5,11(10H)-dione (33)

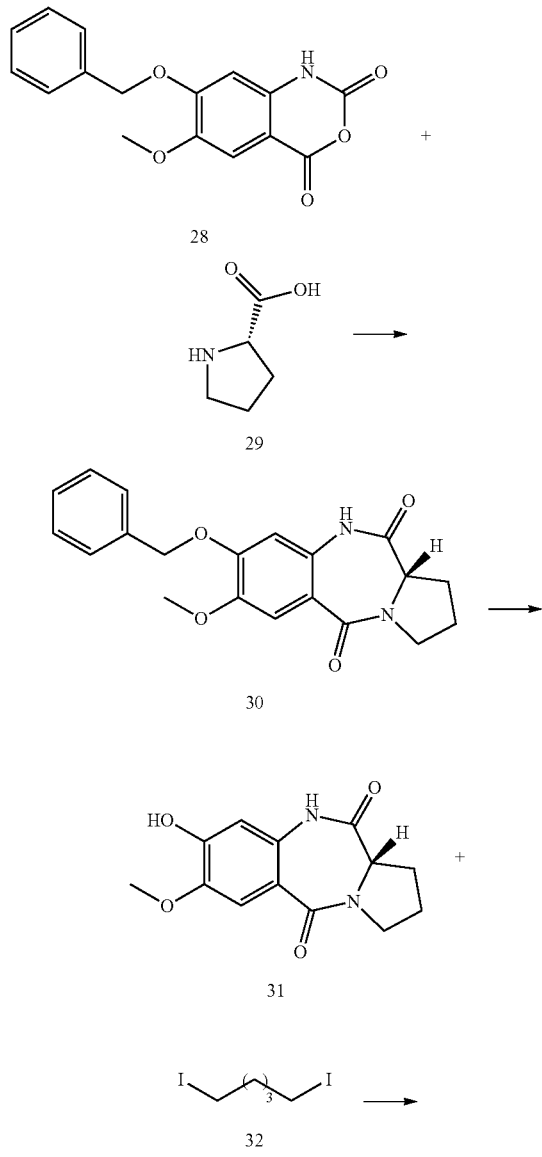

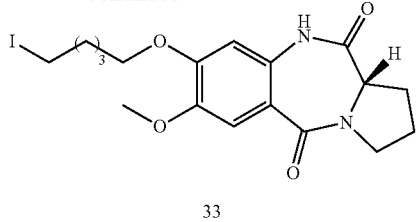

(i) (S)-8-(benzyloxy)-7-methoxy-1,2,3,11a-tetrahydro-5H-pyrrolo[2,1-c][1,4]benzodiazepine-5,11(10H)-dione (30)

A suspension of benzyl isatoic anhydride 28 (1.34 g, 4.48 mmol, 1.0 eq.) and L-proline 29 (0.705 g, 6.12 mmol, 1.36 eq.) in anhydrous DMSO (20 mL), in a sealed vial, was heated under microwave irradiation at 150° C. with stirring for 12 minutes. The resultant yellow solution was allowed to cool to room temperature and poured onto ice. The precipitated product was collected by filtration, dissolved in DCM (200 mL) and the solution was washed with saturated NaCl solution (200 mL), dried (MgSO$_4$) and evaporated under reduced pressure to give the product 30 as a yellow solid (1.35 g, 85%). Analytical Data: RT 1.39 min; MS (ES$^+$) m/z (relative intensity) 353 ([M+H]$^+$, 100).

(ii) (S)-8-hydroxy-7-methoxy-1,2,3,11a-tetrahydro-5H-pyrrolo[2,1-c][1,4]benzodiazepine-5,11(10H)-dione (31)

A slurry of 10% Palladium on carbon (0.27 g, 20 wt. %) in ethylacetate (10 mL) was added to a suspension of benzyl dilactam 30 (1.35 g, 3.8 mmol) in a mixture of ethanol (60 mL), ethylacetate (40 mL) and DMF (5 mL). The mixture was hydrogenated at 45 psi for 2 hours. The reaction mixture was filtered through celite and the solvent evaporated under reduced pressure to give a viscous gum. The gum was sonicated with diethyl ether (50 mL) and the resultant product collected by filtration. This gave the desired product 31 as an off-white powder (0.86 g, 85%). Analytical Data: RT 1.02 min; MS (ES$^+$) m/z (relative intensity) 263 ([M+H]$^{+\cdot}$, 100).

(iii) (S)-8-((5-iodopentyl)oxy)-7-methoxy-1,2,3,11a-tetrahydro-5H-pyrrolo[2,1-c][1,4]benzodiazepine-5,11(10H)-dione (33)

To a solution of 31 (400 mg, 1.5 mmol) in anhydrous DMF (4 mL), in a flask purged with argon, was added K$_2$CO$_3$ (320 mg, 1.5 mmol) and 1,5-diiodopentane 32 (1.1 mL, 7.6 mmol). The reaction mixture was heated to 60° C. until complete (30 minutes). The solution was diluted with CH$_2$Cl$_2$ (50 mL) and washed with H$_2$O (50 mL) and brine (50 mL) before the organics were dried with MgSO$_4$, filtered and the volatiles remove in vacuo. The crude material was purified by silica gel column chromatography (Hexane/EtOAc; 100% to 3:7) to afford pure product 33 as a light brown foamy gum (611 mg, 87% yield). Analytical Data: RT 1.51 min; MS (ES$^+$) m/z (relative intensity) 458.95 ([M+H]$^+$, 100).

(c) 1-(3-(2,5-dioxo-2,5-dihydro-1H-pyrrol-1-yl)propanamido)-N—((S)-1-(((S)-1-((4-((S)-7-methoxy-8-((5-(((S)-7-methoxy-5,11-dioxo-2,3,5,10,11,11a-hexahydro-1H-pyrrolo[2,1-c][1,4]benzodiazepin-8-yl)oxy)pentyl)oxy)-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)-3,6,9,12,15,18,21-heptaoxatetracosan-24-amide (36)
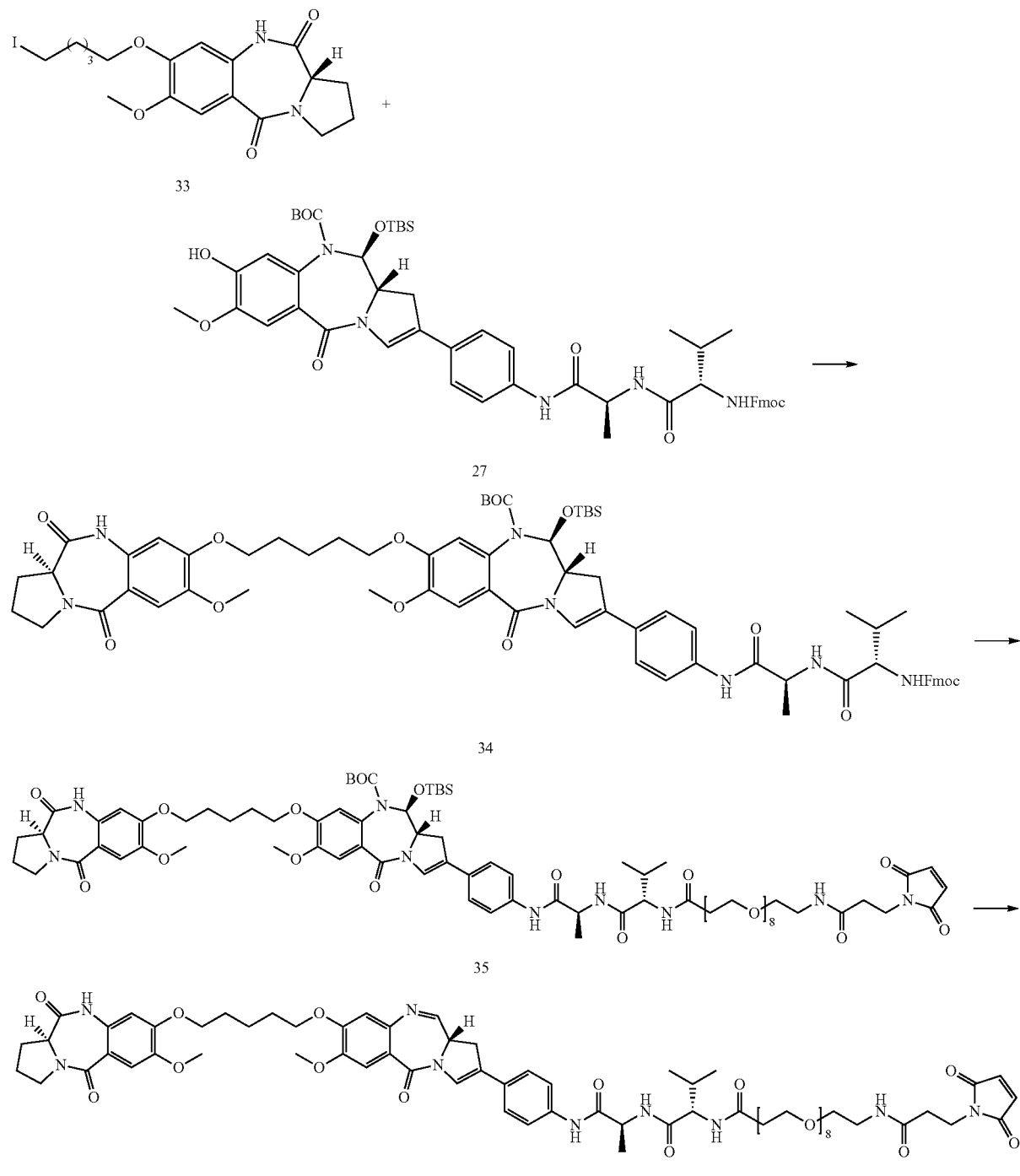

(i) tert-butyl (11 S,11aS)-2-(4-((S)-2-((S)-2-amino-3-methylbutanamido)propanamido)phenyl)-11-((tert-butyldimethylsilyl)oxy)-7-methoxy-8-((5-(((S)-7-methoxy-5,11-dioxo-2,3,5,10,11,11a-hexahydro-1H-pyrrolo[2,1-c][1,4]benzodiazepin-8-yl)oxy)pentyl)oxy)-5-oxo-11,11a-dihydro-1H-pyrrolo[2,1-c][1,4]benzodiazepine-10(5H)-carboxylate (34)

To a solution of 33 (250 mg, 0.545 mmol) and 27 (570 mg, 0.6 mmol) in anhydrous DMF (4 mL), in a flask purged with argon, was added $K_2CO_3$ (115 mg, 0.545 mmol) and the mixture was heated to 60° C. until reaction was complete (45 minutes). The solution was diluted with $CH_2Cl_2$ (50 mL) and washed with $H_2O$ (50 mL) and brine (50 mL) before the organics were dried with $MgSO_4$, filtered and the volatiles remove in vacuo. The crude material was purified by silica gel column chromatography ($CHCl_3$/MeOH; 100% to 95:5) to afford pure product 34 as a white foam (337 mg, 58% yield). Analytical Data: RT 1.42 min; MS (ES$^+$) m/z (relative intensity) 1069.05 ([M+H]$^+$, 80).

(ii) tert-butyl (11S)-11-((tert-butyldimethylsilyl)oxy)-2-(4-((2S,5S)-37-(2,5-dioxo-2,5-dihydro-1H-pyrrol-1-yl)-5-isopropyl-2-methyl-4,7,35-trioxo-10,13,16,19,22,25,28,31-octaoxa-3,6,34-triazaheptatriacontanamido)phenyl)-7-methoxy-8-((5-MS)-7-methoxy-5,11-dioxo-2,3,5,10,11,11a-hexahydro-1H-benzo[e]pyrrolo[1,2-a][1,4]diazepin-8-yl)oxy)pentyl)oxy)-5-oxo-11,11a-dihydro-1H-benzo[e]pyrrolo[1,2-a][1,4]diazepine-10(5H)-carboxylate (35)

To a solution of 34 (337 mg, 0.31 mmol) in dry $CH_2Cl_2$ (5 mL) was added the PEG moiety (186 mg, 0.31 mmol) and EDCl.HCl (60 mg, 0.31 mmol). The mixture was stirred at room temperature under an atmosphere of argon until completion. The mixture was subsequently diluted with $CH_2Cl_2$ (50 mL) and washed with $H_2O$ (50 mL) and brine (50 mL) before removing the volatiles in vacuo. The crude material was purified by silica gel column chromatography ($CHCl_3$/MeOH; 100% to 95:5) to afford pure product 35 as a light yellow foam (408.8 mg, 58% yield). Analytical Data: RT 1.75 min; MS (ES$^+$) m/z (relative intensity) 1643.15 ([M+H]$^+$, 10) 822.25 ([M+2H]$^{2+}$, 100).

(iii) 1-(3-(2,5-dioxo-2,5-dihydro-1H-pyrrol-1-yl)propanamido)-N—((S)-1-(((S)-1-((4-((S)-7-methoxy-8-((5-(((S)-7-methoxy-5,11-dioxo-2,3,5,10,11,11a-hexahydro-1H-pyrrolo[2,1-c][1,4]benzodiazepin-8-yl)oxy)pentyl)oxy)-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)-3,6,9,12,15,18,21-heptaoxatetracosan-24-amide (36)

To a flask containing 35 (400 mg, 0.24 mmol) cooled to 0° C. were subsequently added $H_2O$ (160 µL) and TFA (3.5 mL). The mixture was left to stir until complete before quenching with ice cold $NaHCO_3$ (50 mL) and extracting with $CH_2Cl_2$ (50 mL+25 mL). The organics were then washed with brine (25 mL), dried over $MgSO_4$, filtered and the volatiles were removed in vacuo to give crude product 36 without further purification. Analytical Data: RT 1.40 min; MS (ES$^+$) m/z (relative intensity) 1410.60 ([M+H]$^+$, 5) 706.10 ([M+2H]$^{2+}$, 100).

---

SEQUENCE LISTING (233 sequences)

SEQ ID NO: 1 - protein, 21 aa, Artificial sequence
  Synthetic sequence: A20FMDV-Cys polypeptide
NAVPNLRGDLQVLAQKVARTC

SEQ ID NO: 2 - protein, 21 aa, Artificial sequence
  Synthetic sequence: A20FMDV-Cys polypeptide
  VARIANT (4)..(18): Xaa is any amino acid residue
NAVXXXXXXXXXXXXXXXRTC

SEQ ID NO: 3 - protein, 137 aa, Artificial sequence
  Synthetic sequence: Anti-Integrin Alpha v Beta 6,  RHAB6.2
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTAVPNLRGDLQVLAQKVAGPYPFDYWGQGTLVTVSS

SEQ ID NO: 4 - protein, 137 aa, Artificial sequence
  Synthetic sequence: Anti-Integrin Alpha v Beta 6, RHCB6.2
QVQLVQSGAEVKKPGASVKVSCKASGYTFIDSYMHWVRQAPGQRLEWMGWIDPENGDTEYAPKFQGRVTITTDTSASTAYMELSSLRSEDTAVYYCARGTPTAVPNLRGDLQVLAQKVAGPYPFDYWGQGTLVTVSS

SEQ ID NO: 5 - protein, 120 aa, Artificial sequence
  Synthetic sequence: Anti-Integrin Alpha v Beta 6, RHF
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTGPYYFDYWGQGTLVTVSS

SEQ ID NO: 6 - protein, 137 aa, Artificial sequence
  Synthetic sequence: Anti-Integrin Alpha v Beta 6, RHFB6
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTAVPNLRGDLQVLAQKVAGPYYFDYWGQGTLVTVSS

SEQ ID NO: 7 - protein, 120 aa, Artificial sequence
  Synthetic sequence: Anti-Integrin Alpha v Beta 6, RHAY100bP
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTGPYPFDYWGQGTLVTVSS

SEQ ID NO: 8 - protein, 106 aa, Artificial sequence
  Synthetic sequence: Anti-Integrin Alpha v Beta 6, RKF
ENVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 9 - protein, 106 aa, Artificial sequence
  Synthetic sequence: Anti-Integrin Alpha v Beta 6, RKFL36L50
ENVLTQSPGTLSLSPGERATLSCSASSSVSYMHWLQQKPGQAPRLLIYLTSNLASGIPDRFSGSGSGTDFTLTISRLEPEDFAVYYCQQRSSYPLTFGGGTKVEIK

SEQ ID NO: 10 - protein, 106 aa, Artificial sequence
  Synthetic sequence: Anti-Integrin Alpha v Beta 6, RKC
EIVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 11 - protein, 116 aa, Artificial sequence
  Synthetic sequence: Anti-CD33, CD33 Hum195 VH
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSS

SEQ ID NO: 12 - protein, 111 aa, Artificial sequence
  Synthetic sequence: Anti-CD33, CD33 Hum195 VK
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIK

SEQ ID NO: 13 - protein, 120 aa, Artificial sequence
  Synthetic sequence: Anti-CD19, CD19 B4 resurfaced VH
QVQLVQPGAEVVKPGASVKLSCKTSGYTFTSNWMHWVKQRPGQGLEWIGEIDPSDSYTNYNQNFKGKAKLTVDKSTSTAYMEVSSLRSDDTAVYYCARGSNPYYYAMDYWGQGTSVTVSS

SEQ ID NO: 14 - protein, 104 aa, Artificial sequence
  Synthetic sequence: Anti-CD19, CD19 B4 resurfaced VK
EIVLTQSPAIMSASPGERVTMTCSASSGVNYMHWYQQKPGTSPRRWIYDTSKLASGVPARFSGSGSGTSYSLTISSMEPEDAATYYCHQRGSYTFGGGTKLEIK

SEQ ID NO: 15 - protein, 120 aa, Artificial sequence [sequence omitted]

SEQ ID NO: 16 - protein, 107 aa, Artificial sequence [sequence omitted]

SEQ ID NO: 17 - protein, 104 aa, Artificial sequence [sequence omitted]

SEQ ID NO: 18 - protein, 115 aa, Artificial sequence
  Synthetic sequence: Anti-CD25, Simulect VH
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSS

SEQ ID NO: 19 - protein, 115 aa, Artificial sequence
  Synthetic sequence: Anti-PSMA, Deimmunised VH '1
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 20 - protein, 107 aa, Artificial sequence
  Synthetic sequence: Anti-PSMA, Deimmunised VK '1
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 21 - protein, 116 aa, Artificial sequence
  Synthetic sequence: Anti-PSMA, Deimmunised VH1 '5
EVKLVESGGGLVQPGGSMKLSCVASGFTFSNYWMNWVRQAPGKGLEWVAEIRSQSNNFATHYAESVKGRVTISRDDSKSIVYLQMNNLRAEDTGVYYCTRRWNNFWGQGTTVTVSS

SEQ ID NO: 22 - protein, 116 aa, Artificial sequence
  Synthetic sequence: Anti-PSMA, Deimmunised VH2 '5
EVKLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 23 - protein, 116 aa, Artificial sequence
  Synthetic sequence: Anti-PSMA, Deimmunised VH3 '5
EVQLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 24 - protein, 116 aa, Artificial sequence
  Synthetic sequence: Anti-PSMA, Deimmunised VH4 '5
EVQLVESGGGLVQPGGSLKLSCVASGFTFSNYWMNWVRQAPGKGLEWVAEIRSQSNNFATHYAESVKGRFTISRDDSKSIVYLQMNNLRAEDTAVYYCTRRWNNFWGQGTTVTVSS

SEQ ID NO: 25 - protein, 107 aa, Artificial sequence
  Synthetic sequence: Anti-PSMA, Deimmunised VK1 '5
NIVMTQFPSSMSASVGDRVTITCKASENVGTYVSWYQQKPDQSPKMLIYGASNRFTGVPDRFTGSGSATDFTLTISSLQTEDLADYYCGQSYTFPYTFGQGTKLEMK

SEQ ID NO: 26 - protein, 107 aa, Artificial sequence
  Synthetic sequence: Anti-PSMA, Deimmunised VK2 '5
NIVMTQFPSSMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 27 - protein, 107 aa, Artificial sequence
  Synthetic sequence: Anti-PSMA, Deimmunised VK3 '5
NIQMTQFPSAMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 28 - protein, 107 aa, Artificial sequence
  Synthetic sequence: Anti-PSMA, Deimmunised VK4 '5
NIQMTQFPSAMSASVGDRVTITCKASENVGTYVSWYQQKPDQSPKMLIYGASNRFTGVPDRFSGSGSGTDFTLTISSLQAEDEADYYCGQSYTFPYTFGQGTKLEIK

SEQ ID NO: 29 - protein, 107 aa, Artificial sequence
  Synthetic sequence: Anti-PSMA, Deimmunised VK DI '5
NIVMTQFPKSMSASAGERMTLTCKASENVGTYVSWYQQKPTQSPKMLIYGASNRFTGVPDRFSGSGSGTDFILTISSVQAEDLVDYYCGQSYTFPYTFGGGTKLEMK

SEQ ID NO: 30 - protein, 116 aa, Artificial sequence
  Synthetic sequence: Anti-PSMA, Deimmunised VH DI '5
EVKLEESGGGLVQPGGSMKISCVASGFTFSNYWMNWVRQSPEKGLEWVAEIRSQSNNFATHYAESVKGRVIISRDDSKSSVYLQMNSLRAEDTAVYYCTRRWNNFWGQGTTVTVSS

SEQ ID NO: 31 - protein, 116 aa, Artificial sequence
  Synthetic sequence: Anti-PSMA, Humanised RHA '5
EVQLVESGGGLVQPGGSLKLSCAASGFTFSNYWMNWVRQASGKGLEWVGEIRSQSNNFATHYAESVKGRFTISRDDSKNTAYLQMNSLKTEDTAVYYCTRRWNNFWGQGTTVTVSS

SEQ ID NO: 32 - protein, 116 aa, Artificial sequence
  Synthetic sequence: Anti-PSMA, Humanised RHB '5
EVKLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 33 - protein, 116 aa, Artificial sequence
  Synthetic sequence: Anti-PSMA, Humanised RHC '5
EVQLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 34 - protein, 116 aa, Artificial sequence
  Synthetic sequence: Anti-PSMA, Humanised RHD '5
EVKLVESGGGLVQPGGSLKLSCAASGFTFSNYWMNWVRQASGKGLEWVGEIRSQSNNFATHYAESVKGRVIISRDDSKNTVYLQMNSLRTEDTAVYYCTRRWNNFWGQGTTVTVSS

SEQ ID NO: 35 - protein, 116 aa, Artificial sequence
  Synthetic sequence: Anti-PSMA, Humanised RHE '5
EVKLVESGGGLVQPGGSLKLSCAASGFTFSNYWMNWVRQASGKGLEWVAEIRSQSNNFATHYAESVKGRFTISRDDSKNTVYLQMNSLRTEDTAVYYCTRRWNNFWGQGTTVTVSS

SEQ ID NO: 36 - protein, 116 aa, Artificial sequence
  Synthetic sequence: Anti-PSMA, Humanised RHF '5
EVKLVESGGGLVQPGGSLKLSCAASGFTFSNYWMNWVRQASGKGLEWVAEIRSQSNNFATHYAESVKGRVIISRDDSKNTAYLQMNSLRTEDTAVYYCTRRWNNFWGQGTTVTVSS

SEQ ID NO: 37 - protein, 116 aa, Artificial sequence; identical to SEQ ID NO: 36
  Synthetic sequence: Anti-PSMA, Humanised RHG '5

SEQ ID NO: 38 - protein, 107 aa, Artificial sequence
  Synthetic sequence: Anti-PSMA, Humanised RKA '5
DIQMTQSPSSVSASVGDRVTITCKASENVGTYVSWYQQKPGTAPKLLIYGASNRFTGVPSRFSGSGSATDFTLTINNLQPEDFATYYCGQSYTFPYTFGQGTKVEIK

SEQ ID NO: 39 - protein, 107 aa, Artificial sequence; identical to SEQ ID NO: 38
  Synthetic sequence: Anti-PSMA, Humanised RKB '5

SEQ ID NO: 40 - protein, 107 aa, Artificial sequence
  Synthetic sequence: Anti-PSMA, Humanised RKC '5
DIQMTQSPSSVSASVGDRVTITCKASENVGTYVSWYQQKPGTAPKMLIYGASNRFTGVPSRFSGSGSATDFTLTINNLQPEDFATYYCGQSYTFPYTFGQGTKVEIK

SEQ ID NO: 41 - protein, 107 aa, Artificial sequence; identical to SEQ ID NO: 40
  Synthetic sequence: Anti-PSMA, Humanised RKD '5

SEQ ID NO: 42 - protein, 107 aa, Artificial sequence
  Synthetic sequence: Anti-PSMA, Humanised RKE '5
NIVMTQSPSSVSASVGDRVTITCKASENVGTYVSWYQQKPGTAPKLLIYGASNRFTGVPDRFTGSGSATDFILTINNLQPEDFATYYCGQSYTFPYTFGQGTKVEIK

SEQ ID NO: 43 - protein, 107 aa, Artificial sequence
  Synthetic sequence: Anti-PSMA, Humanised RKF '5
NIVMTQSPSSVSASVGDRVTITCKASENVGTYVSWYQQKPGTAPKMLIYGASNRFTGVPSRFSGSGSATDFILTINNLQPEDFATYYCGQSYTFPYTFGQGTKVEIK

SEQ ID NO: 44 - protein, 107 aa, Artificial sequence
  Synthetic sequence: Anti-PSMA, Humanised RKG '5
NIVMTQSPSSVSASVGDRVTITCKASENVGTYVSWYQQKPGTAPKMLIYGASNRFTGVPDRFTGSGSATDFTLTINNLQPEDFATYYCGQSYTFPYTFGQGTKVEIK

SEQ ID NO: 45 - DNA, 5560 bp, Homo sapiens
cgcggggcgcggagtcggcggggcctcgcgggacgccgggcagtgcggagaccgcggcgctgaggacgcgggagccgggagcgcagccgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaaca

SEQ ID NO: 46 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 47 - DNA, 4543 bp, Homo sapiens
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 48 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 49 - DNA, 1330 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaaaaaaaaaaaaaaaaa

SEQ ID NO: 50 - protein, 339 aa, Homo sapiens
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 51 - DNA, 21112 bp, Homo sapiens
cctgtgacttctcttctcacccctggcctggtgataaccacagacaggatgggcataagcagagaacctggaaccagttccacttcaaatttgagcagcacctcccatgagagactgaccactttggaagacactgtagatacagaagccatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcgtctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagtgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccattcaactgcatctcaaggattttcacactcacagatgaccgctcttatgagtagaactcctggagaggtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacggtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggaggataccactgttttcacatcaaatcctgccttctctgagactaggaggattccgacagagccaacattctcattgactcctggattcagggagactagcacctctgaagagaccacctcaatcacagaaacaagtgcagtcctttttggagtgcccactagtgctactactgaagtctccatgacagaaataatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggacttaggaagaccaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctggcacagacagaaatatgactattccaactttgactctttctcctggtgaaccaaagaccatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcattctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctttctggtcactagttctagagcagtaaccagtacaactattccaactctgactatttcttctgatgaaccagagaccacaacttcattggtcacccattctgaggcaaagatgatttcagccattccaactttaggtgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacatacaagttcagccattccaactctccctgtctcccctgatgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttcaaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccttacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagccattgttcaagaacaccagtgttggccctttgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagaccctggttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccaactgaccaatggcatcaaagagctgggcccctacaccctggacaggaacagtctctatgtcaatggtttcacccattggatccctgtgcccaccagcagcacccctgggacctccacagtggaccttgggtcagggactccatcctccctccccagccccacaagtgctactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaaaaaaaaaaaaaaaaaaaaaaaa

SEQ ID NO: 52 - protein, 6995 aa, Homo sapiens
PVTSLLTPGLVITTDRMGISREPGTSSTSNLSSTSHERLTTLEDTVDTEAMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGEVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPRSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVEDTTVFTSNPAFSETRRIPTEPTFSLTPGFRETSTSEETTSITETSAVLFGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGLRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHSAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTFLVTSSRAVTSTTIPTLTISSDEPETTTSLVTHSEAKMISAIPTLGVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPDASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLVGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTSATAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 53 - DNA, 2187 bp, Homo sapiens
tgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaaaaaaaaaaaaaaaa

SEQ ID NO: 54 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 55 - DNA, 4167 bp, Homo sapiens
accttcgccatatatacccggggcgctgcgctccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaaaaaaaaaaaaaaaa

SEQ ID NO: 56 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 57 - DNA, 4559 bp, Homo sapiens
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggacctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaactggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccacaggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 58 - protein, 1202 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEDLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 59 - DNA, 1524 bp, Homo sapiens
gcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagaga

SEQ ID NO: 60 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 61 - DNA, 1329 bp, Homo sapiens
atgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 62 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 63 - DNA, 4573 bp, Homo sapiens
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 64 - protein, 783 aa, Homo sapiens
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 65 - DNA, 6857 bp, Homo sapiens
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaactgttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccaaaagctaaaacgaattaaaaaaggctgggaaaagagccaatttctggaagaaggtattggaggaacaattcctcatgtctccccggagagggtcacagtaatgtgatgataaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcctccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcatgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccctacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 66 - protein, 490 aa, Homo sapiens
MESISMMGSPKSLSETVLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISQKLKRIKKGWEKSQFLEEGIGGTIPHVSPERVTVM

SEQ ID NO: 67 - DNA, 4103 bp, Homo sapiens
aggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgaaaaaaa

SEQ ID NO: 68 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 69 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 70 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 71 - DNA, 3934 bp, Homo sapiens
gccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacagggatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatgaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttactgtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaa

SEQ ID NO: 72 - protein, 1033 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCMKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 73 - DNA, 1300 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 74 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 75 - DNA, 2592 bp, Homo sapiens
agagtctccagttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctataaaa

SEQ ID NO: 76 - protein, 508 aa, Homo sapiens
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 77 - DNA, 4530 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagacgaaataaagacccaggggagaatgggtgttgtatggggaggcaagtgtggggggtccttctccacacccactttgtccatttgcaaatatattttggaaaac

SEQ ID NO: 78 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 79 - DNA, 2533 bp, Homo sapiens
ggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccattcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 80 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 81 - DNA, 1583 bp, Homo sapiens
gtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaaaaaaaaaaaaaaaaa

SEQ ID NO: 82 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 83 - DNA, 3485 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatgacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 84 - protein, 553 aa, Homo sapiens [sequence omitted]

SEQ ID NO: 85 - DNA, 2558 bp, Homo sapiens
tgtggcactgcctgcgtacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaattgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgc

SEQ ID NO: 86 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 87 - DNA, 4869 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 88 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 89 - DNA, 1658 bp, Homo sapiens
ggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggggacaccgattttataaataaactgagcaccttctttttaaacaaaaaaaaaaaaaaaaaaaaaaaaaaaaaaaaaaaaaaaaaaaaaaaaaaaa

SEQ ID NO: 90 - DNA, 946 bp, Homo sapiens
tgacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtttgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagca

SEQ ID NO: 91 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 92 - DNA, 1852 bp, Homo sapiens
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 93 - protein, 236 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 94 - DNA, 1052 bp, Homo sapiens
tgccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaata

SEQ ID NO: 95 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 96 - DNA, 2544 bp, Homo sapiens
agatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcaataaagaatcttacttaagccaggtgcggtggctcacgcctgtcatctcagcactttgggaggccaaggcgggaggatcacttgaggtcaggagttcgagaccagcctggccagcatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccaccctcaagccatgacatgaattggggattatctggttaggtctttttgttcccctcttggtggggatttttttcgcatcattatcttgtgcctcattcattcaataaatacgtatcatgaacctactaggtaccaggccctattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaaaaaaaaaaaaaaaa

SEQ ID NO: 97 - protein, 240 aa, Homo sapiens
MLPGSLKREDTRKQVKIILLLFCIQQASYYGTAVMGQAYLPELGTQWGPPWLSLTGVTTGCRQTPVLSILLARPAESSESRVGYWMPRREEGAREVSPKVLQGPQQAWTEEVWTAWPCPEPLCIITAVPNLHPTLSLPIPGPGALLLCSRDSWSSLRQHTVLLWRRPSPTHAGMLQPVPEQVVAGGCWQRRDNGPAPGGKCWLQGTESSPCHSPCYPLGNLKGISKNSGSATLLSFLWNM

SEQ ID NO: 98 - DNA, 2116 bp, Homo sapiens
acgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagttttccccagac

SEQ ID NO: 99 - protein, 647 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGTMRTSFQIFQKMRGFITQS

SEQ ID NO: 100 - DNA, 1258 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 101 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 102 - DNA, 2919 bp, Homo sapiens
aaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtaaaaaaaaaaaaaaaaa

SEQ ID NO: 103 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 104 - DNA, 1388 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtaaaaaaaaaaaaaaaaa

SEQ ID NO: 105 - protein, 273 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 106 - DNA, 2341 bp, Homo sapiens
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaaaaaaaaaaaaaaaaaaaaaaaaaaaaaaaaaa

SEQ ID NO: 107 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 108 - DNA, 1548 bp, Homo sapiens
aattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 109 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 110 - DNA, 2725 bp, Homo sapiens
agaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacgatcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaaaaaaa

SEQ ID NO: 111 - protein, 661 aa, Homo sapiens
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 112 - DNA, 3116 bp, Homo sapiens
aacttccgatatcaacttcctcaaacctctgatgagctgctgctgctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtcttcaatgtctctcaggtaaggctgtatcaatttatatcttcaccaacaacgtctgggaaatcagtttgtggggtgtattacttagttttcacattgctaataaagacatatccaagactgggtaatttataaaaaaaaaaaaaaaaaaaa

SEQ ID NO: 113 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 114 - DNA, 2797 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacg

SEQ ID NO: 115 - protein, 759 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 116 - DNA, 1814 bp, Homo sapiens
gcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaa

SEQ ID NO: 117 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 118 - DNA, 2653 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 119 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 120 - DNA, 2996 bp, Homo sapiens
cgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaaaaaaaaaaaaaaaaaaaa

SEQ ID NO: 121 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 122 - DNA, 1245 bp, Homo sapiens
cgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccgcccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccgg

SEQ ID NO: 123 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 124 - DNA, 5717 bp, Homo sapiens
ggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcattttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagcaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagcaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatct

SEQ ID NO: 125 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 126 - DNA, 2397 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 127 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 128 - DNA, 3036 bp, Homo sapiens
cgaccagcagaccagacagtcacagcagccttgacaaaacgttcctggaactcaagcacttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccatgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtat

SEQ ID NO: 129 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 130 - DNA, 90 bp, Homo sapiens
ttggctttggtcttcaagtagccaaagcgatgaaatatcttgcaagcaaaaagtttgtccacagagacttggctgcaagaaactgtatgt

SEQ ID NO: 131 - protein, 22 aa, Homo sapiens
KAMKYLASKKFVHRDLAARNCM

SEQ ID NO: 132 - DNA, 1804 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacaccgtccttcagaggccccaccaatttctcggacacttctcagtgtgtggaagctcatgtgggcccctgaggctcatgcctgggaagtgttgtggtgggggctcccaggaggactggcccagagagccctgagatagcggggatcctgaactggactgaataaaacgtggtctcccactg

SEQ ID NO: 133 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 134 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 135 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 136 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 137 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 138 - DNA, 1437 bp, Homo sapiens
gcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaaccttacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggactggttcatggggccattggaggagctggtgttacagccctgctcgctctttgtctctgcctcatcttcttcatagtgaagacccacaggaggaaagcagccaggacagcagtgggcagcaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 139 - protein, 364 aa, Homo sapiens
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGLVHGAIGGAGVTALLALCLCLIFFIVKTHRRKAARTAVGSNDTHPTTGSASPKHQKNSKLHGPTETSSCSGAAPTVEMDEELHYASLNFHGMNPSKDTSTEYSEVRTQ

SEQ ID NO: 140 - DNA, 1968 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcctaaaaaaaaaaa

SEQ ID NO: 141 - protein, 557 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 142 - DNA, 3216 bp, Homo sapiens
ggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatatttttt

SEQ ID NO: 143 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 144 - DNA, 3227 bp, Homo sapiens
gctgggcaaagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctaagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccacttttccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcaaaaaaaaaaaaaaaaaaaaa

SEQ ID NO: 145 - protein, 885 aa, Homo sapiens [sequence omitted]

SEQ ID NO: 146 - DNA, 3630 bp, Homo sapiens
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacagcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttaaaaaaaa

SEQ ID NO: 147 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 148 - DNA, 3802 bp, Homo sapiens
  misc_feature (1064)..(1065): n is a, c, g, or t
  misc_feature (1240)..(1240): n is a, c, g, or t
  misc_feature (1862)..(1862): n is a, c, g, or t
  misc_feature (1878)..(1878): n is a, c, g, or t
  misc_feature (1899)..(1900): n is a, c, g, or t
  misc_feature (1906)..(1906): n is a, c, g, or t
  misc_feature (1917)..(1917): n is a, c, g, or t
  misc_feature (1928)..(1929): n is a, c, g, or t
  misc_feature (2395)..(2395): n is a, c, g, or t
cccctgcagctggcctcaatgttaagatcttaaggggcacagcacagaccttgtcttgtctatctccctggcacctctcacagagtacagcttattaacagatgttccagaaactgttactgaacaatcggcttgatgctgtgggcttgtctgcatcttgcaactgtcacctggctgagaaatttcttctataaataagcagtttctgtttcagatgtgatatgccctgatatttacaccctgtctcttaccccatccaagactcaaacttagaaacttgaattagatgtggtattcaaatccttacgtgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattatttttagcaaaataatcaagtatgacagccgggtgcggtggatggctcacacctgtaatcccagcactttgggaggccgagatgggtgaatcacctgaggtcggcagtttgagnncagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcaactctagcctnggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcnagatctatggtcakgnttttatacaaatataggtgtnnyttgcntgagtgaacantttactactgnnaaaatgttagaaatgaataaccagttgctcctgaattatttgaggaatcatctaaaaaataattatttttaagcaatagagaaccagtcccagaaaaatgaatgttctacttaagtgcctcttaagataaaaaatacttctgcagcacctttgctcatgattggattcccaagcatgtacagccactgccctatttctgtatgcatttatttatttatttatttatttatttatttagagatggagtctcgctctgtggcccaaggctggagtgcagtggcgtgatctcaactcactgcagcctctgcctcttgggttcaaacaattctcccatctcagcctcctgagtaactggactataggtatgtgccatcacctccgactaatttttgtactttttggtagagacagggtttcatcatgttggccaggatggtctcaagctcctgaccacaagtgatctgcncgcctcagcttcccaaagtgctgggattacaggcgtgagccacagggcccagcacatactcattcttttttactgaaaagatctgtttcaagctgggtgttggtggctatggagctgtagtccgactgctctgtaggctaacgtgggaggattgcttgagcccagagtttgaatgcagcctgggcaacacagtaagaccccacctctaaaaaatgaaaaaatctctctcacattgctttgagtcccgatgtgtactgctaagactctcatgaccacattctctgtgaagtttgggttaagttccgttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaagtctttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtgctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgtaatcccagctactcaggaggctgaggcaggagaatcgcttgaacctgggaggtggaggttgcaatgagctgagatagcatccctgcactccagcctgggcaagagggtgagactccgtctcaaaacaaaacaacacaaacaaacaaaaagtacctccagcttcatcttctgctggattttatagcgcccccaaagatatgtggtccttaaaaattgtataccacttattcaggagtcttgttcctgaaagggttgttcttgttacagccctagtctgggctgtaatcagcttcttaaggtcc

SEQ ID NO: 149 - protein, 184 aa, Homo sapiens [sequence omitted]

SEQ ID NO: 150 - DNA, 2607 bp, Homo sapiens
tctgttcccacttcctccccgccccaggaaacctgccatggcctcctggtgagctgtcctcatccactgctcgctgcctctccagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaaaaaaaaaaaaaaa

SEQ ID NO: 151 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 152 - DNA, 2371 bp, Homo sapiens
tctcctcttgctctaagcagggtgtttgaccttctagtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataacccagactcaaatatcattgccttcctccaggagtaattaggaacagctgagggcatgctgggagtaagcagcaagagtgcattctgcttttagattgagggagaggt

SEQ ID NO: 153 - protein, 490 aa, Homo sapiens
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 154 - DNA, 3973 bp, Homo sapiens
gggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaa

SEQ ID NO: 155 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 156 - DNA, 926 bp, Homo sapiens
ccagagaggggcaggcttgtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgtctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtttgtggcaggacaagagaaggcattgagctttttctttcattttcctattaaaaaatacaaaaatcaaaacaaaaaaaa

SEQ ID NO: 157 - protein, 193 aa, Homo sapiens [sequence omitted]

SEQ ID NO: 158 - protein, 293 aa, Artificial sequence
  Synthetic construct
MGILPFLLIPMESNWTVHVFSRTLCHMLLWTAVLNLAAGTHDLPKAVVKLEPPWIQVLKEDTVTLTCEGTHNPGNSSTQWFHNGRSIRSQVQASYTFKATVNDSGEYRCQMEQTRLSDPVDLGVISDWLLLQTPQLVFLEGETITLRCHSWRNKLLNRISFFHNEKSVRYHHYSSNFSIPKANHSHSGDYYCKGSLGRTQHQSKTVTITVQGPKSSRSLPVLTIVAAVTGIAVAAIVIILVSLVYLKKKQVPDNPPDLEEAAKTEAENTITYSLLKHPEALDEETEHDYQNHI

SEQ ID NO: 159 - DNA, 2880 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 160 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 161 - DNA, 3977 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 162 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 163 - DNA, 3858 bp, Homo sapiens
ctactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaagaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgattttttctggagaattgtaaaataaagttttctatttttccttaaaaaaaaaaccggaattccgggcttgggaggctgaggcaggagactcgcttgaacccgggaggcagaggttgcagtgagccaagattgcgccattgcactccagagcctgggtgacagagcaagactacatctcaaaaaataaataaataaaataaaagtaacaataaaaataaaaagaacagcagagagaatgagcaaggagaaatgtcacaaactattgcaaaatactgttacactgggttggctctccaagaagatactggaatctcttcagccatttgcttttcagaagtagaaaccagcaaaccacctctaagcggagaacatacgattctttattaagtagctctggggaaggaaagaataaaagttgatagctccctgattgggaaaaaatgcacaattaataaagaatgaagatgaaagaaagcatgcttatgttgtaacacaaaaaaaattcacaaacgttggtggaaggaaaacagtatagaaaacattactttaactaaaagctggaaaaattttcagttgggatgcgactgacaaaaagaacgggatttccaggcataaagttggcgtgagctacagagggcaccatgtggctcagtggaagacccttcaagattcaaagttccatttgacagagcaaaggcacttcgcaaggagaagggtttaaattatgggtccaaaagccaagtggtaaagcgagcaatttgcagcataactgcttctcctagacagggctgagtgggcaaaatacgacagtacacacagtgactattagccactgccagaaacaggctgaacagccctgggagacaagggaaggcaggtggtgggagttgttcatggagagaaaggagagttttagaaccagcacatccactggagatgctgggccaccagacccctcccagtcaataaagtctggtgcctcatttgatctcagcctcatcatgaccctggagagaccctgataccatctgccagtccccgacagcttaggcactccttgccatcaacctgaccccccgagtggttctccaggctccctgccccacccattcaggccggaattc

SEQ ID NO: 164 - protein, 875 aa, Homo sapiens
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQKKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 165 - DNA, 585 bp, Homo sapiens
caacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaaaaaaaaaaaaaaaa

SEQ ID NO: 166 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 167 - DNA, 3850 bp, Homo sapiens
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaaaaaaa

SEQ ID NO: 168 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 169 - DNA, 2744 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 170 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 171 - DNA, 5551 bp, Homo sapiens
  misc_feature (1769)..(1769): n is a, c, g, or t
ttttcatggaaatatcttcaaatttcattagtggtcctattatagaagacacacagcaggcaagtgtcagagctagaaatgaccctaaatttctgggtccctattcagcagccataagcaattgccagctgcaggaaggtggaggcagaagaagtaaaaagggaacaagaggtgaggtttacgttctgcctaagtggaacagagtagaactttgcacaaactccttaatcttgcctagaggcagaatgtgggatgtactatatgggaggcaggcaaatctgggcctggttcccacctccatcactcatttgaacaagttatgtaatttatttttgcgtcaattttcttgtctgtaaaactggagtgagaggacctaacttgagtaccgaagtgaagagtcaatgagataatatctgtgatcagcacagtgcttggcaagtggaagacactcagtcaagctaacttaaagccccagttttttcatttgtacaacagaacaacaacaataatagcaacaagcaataatactaacaatatttatcttgcctctgagttgtcttgaaaatcagatgagtatatatattatgtttctaaattctaaagtgtatctcactctcctaacaaagcagttggtcttcagatcaggaccagagttaataccatgccagagcattattacaggttttttccaatgagtaattaattttatttttaaacttatcatacagtaaaattgactcttttggtttacaaagttctatgagttatagcacgttgtataggtttatgtaaccaccaccacaatccggatacagaacatgactacagctttagagattctttttcaaagtgttttacattcatgttgcaaaacacttttaaaaataagaaaagagatgtagataaacgtgctgaagatgcaaattaatgaaaccagcttttgtgcacaaatctctgcagtttccagtgttttcagcttttgtctgagccatttttgctgtcggctttgcagactatctctttctataaaagtaatcaggcgtccgttggagagttgggtctttcttcacattaaaggcacatgtcccaggcacaagcctcaggatccttatttgatcttttttaatacgaccaggtcttaaatttccgaaccatgttttccctaattgccattttctctctaaaatgaagaagcctggaagaaccttcttatcccttcggggaaattatttaattgggacaaaggggatgtggagttacagagagcaacgatagggctttcaggaacccaaaacctgtctggtataataacagatccttccggtaaccaaccattcaatttgtccctctcccccaaccccatcctctccatcaccatctgccagatggccccctgggaccaatcgactttgaaaccaaacttctctcccaggtcagctcctgcaatccccactcctcgtcccttggagctttctccacagaagtgacttgacacaccgcgctacatctggggaggggggcgggtccgctttccgggagactcaagtctttgctatttgccttttgtttctgggatgcctttggctgcctttctcttccatctgcttttaattttggtaagagaaaagctaatgaatcaggaatgaatctcctctccactaatctttwtgttttctttctctctctctctctcttagagttggcgcgctctcttcacgagttccatcactacccaagaagtgagggggcgggggggacaggcgggaagncattaattacacctaaatctgaagtttgcggcctcaagtaccactttgatggggagagcttctgaagcttccatacaacctgccgtgcctttgctgctgccgcagtagattttcagctcatttctttctgctgctgcttcgcgctgctctgtcatgcctaaatctatctcgtcactgccaaaggtgcctgaatcagggtgaattccacgagattcaccagcggttttgctccagtccaaggtaaatacagtatgcaaaatgaggaaccacccaaggatgtcggggaggggggagagaaagggattccctcaccttttccggcacattcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtgagcagtgggagcccgcggcctgggagagacccgggaggcgtcgttggggcccctccccatcctcgggtggagagtagggttggttcgggttgccactgtaccccgagtcccactgctgctttgttcccagactctcccctcctctttggagatgacttgaacccctttgagatccgaggggctggcggggcgcgggctggggggcgacagttgtagctccacttcctgctaatgcgagaaggtacaaaaagagatcaaaaagtcctgtaacctgaaacttccctcgcatcctaaccgggaccgggtggagaggtctgggcgggggcggagacacccggaggccgaccttccgccgaggcggtgcaggaaggaacgggagagggagaagtttggtagggaaggaattggggattaagcggtaagttagacgcgggagacgatctcctcgggaaaggcggagggcgggaggccggtcgggtttatttagtgtgggccagggaagaaggaagactttgcggtctgggtgtcggatgcgcgtccccctccggagtaaaagtgaccggaggggttggggaggcgaggccggggcgggcttttggaaggaggtctctgggacagactggagacgactagactcgaaaaggccggtttttgcactccggaagccgcggcagccaccgctgttcacgcctctctcctgcttgtcccaggtccctcagaggatccagcgaggggtgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaataaacattgttaaaacaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgtttcgaaatgg

SEQ ID NO: 172 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 173 - DNA, 5977 bp, Homo sapiens
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaaaaaaaaaaaa

SEQ ID NO: 174 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 175 - DNA, 1108 bp, Homo sapiens
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcac

SEQ ID NO: 176 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 177 - DNA, 2669 bp, Homo sapiens
cagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccatatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaaaaa

SEQ ID NO: 178 - protein, 560 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 179 - DNA, 1440 bp, Homo sapiens
gttacccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaacgacaactgttccaacaacaatgagcattccaacgacaacgactgttccgacgacaatgactgtttcaacgacaacgagcgttccaacgacaacgagcattccaacaacaacaagtgttccagtgacaacaacggtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgactgcagaagactgaacaggtatcagcacatcagatgtcttttagactccaagacaatttttctgtttcagtttcatctggcattccaacatgtcagtgatactgggtagagtaactctcccactccaaactgtgtatagtcaacctcatcattaatgtagtcctaatttgttttgctaaaactggctcaatccttctgatcattgcagagttttctctcaaacatgaacactttagaattgtatgttctctttagaccccataaatcctgtat

SEQ ID NO: 180 - protein, 359 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPTTTVPTTMSIPTTTTVPTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 181 - DNA, 2671 bp, Homo sapiens
ggtgagtcaccaaggaaggcagcggcagctccactcagccactgcaattgtgtccggaatttattccttctggtgggttcatggtcttgctgacttcaagaatgaagccgctgacctcgcgcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccggcccacagtggtctgggcatcccaagttgaccagggagccaacttctcggaagtctccaataccagctttgagctgaactctgagaatgtgaccatgaaggtagtgtctgtgctctacaatgttacgatcaacaacacatactcctgtatggttgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgccgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgccactaccaactagtggatagaggccagggatgctgctcaacctcctaccatgtacaggacgtctccccattacaactacccaatccgaagtgtcaactgtgtcagggctaaggaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacaaaaaaaaaaaaaaaaaaaaaaaaaaaaaaaaaataaaaaaaaaaaaaaaaaa

SEQ ID NO: 182 - DNA, 1164 bp, Homo sapiens
agtggggccaggggagtcatctttttccgttgcgggtacccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgtttttgtttttttgtttttgtttttgtttttacactcgctgctctcaataaataagcctttttta

SEQ ID NO: 183 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 184 - DNA, 1229 bp, Homo sapiens
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaaaaaaaaaaaaaaa

SEQ ID NO: 185 - protein, 213 aa, Homo sapiens
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 186 - DNA, 3148 bp, Homo sapiens
gtgggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggca

SEQ ID NO: 187 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 188 - DNA, 1506 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 189 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 190 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 191 - protein, 1210 aa, Homo sapiens [sequence omitted]

SEQ ID NO: 192 - DNA, 4975 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 193 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMGGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGGSCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 194 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 195 - protein, 661 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTN

SEQ ID NO: 196 - DNA, 3935 bp, Homo sapiens
aggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagaaaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaaaaaaaaaaaaa

SEQ ID NO: 197 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 198 - DNA, 1146 bp, Homo sapiens
cctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcttggcagcaacggagaaaaactctaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcc

SEQ ID NO: 199 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 200 - DNA, 8605 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaaaaaaa

SEQ ID NO: 201 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 202 - DNA, 2814 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttcctacaaaatatgctctctggtggtctcctaatggaaaatttttggcatatgcggaatttaatgataaggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaagaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaaaaaaaaaaaaaaaaaaaaaaaaagcggccgctcg

SEQ ID NO: 203 - protein, 760 aa, Homo sapiens [sequence omitted]

SEQ ID NO: 204 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 205 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 206 - DNA, 523 bp, Homo sapiens
ctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaaaaa

SEQ ID NO: 207 - protein, 61 aa, Homo sapiens
MKRFLFLLLTISLLVMVQIQTGLSGQNDTSQTSSPSASSNISGGIFLFFVANAIIHLFCFS

SEQ ID NO: 208 - DNA, 2672 bp, Homo sapiens
cttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatagaaatgtaaatgcaaggtcacacatattaatgacagcctgttgtattaatgatggctccaggtcagtgtctggagtttcattccatcccagggcttggatgtaaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcaaaaaaaaaaaaaaaa

SEQ ID NO: 209 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 210 - DNA, 3292 bp, Homo sapiens
ccgcggtggtcccaatctcttccttcctccatgaggtgtctggggtcggggccccagttcttcctggagtccatctggagtctctcctactttctagagaatccattgggtcttgtttacaacgtggatggggacagactgtgcagcgtggagggaaggggagggagggaggtttgggaagagcctcctgtggggtcctgtcactgccccagatgccccaacaccctgtgatacctgcacccctgccacatctgtccctcactccaaactcagctcaaggggatggtggcagggaagaaggtgagcttggaacccaggcagccctggggtcaccacctccagctggggttcctcctctgtaaagtggaggtataacggtacccacctcctggggtggctgtgaggattcagagctgataaggtgaacgcctagggcgggccctggtgcagagagagcgctcagctcctaggctggattaactgtccctggggcacagatctcggtctggggcctgtggaaacctcagagccacccctgaacccccaccgagccacctttgcctcgcagtgccatggcctcgtctccgagttacaggaaaaggcagagaatgcccttctcaggtggccctctgggagagacactctccttgactccaaagccacgcttggctgcaaactgggccagcaccacaaggctgggcaagcaaacatcctaatcccaccaaaaccacaccgacctccaccctgtgacactctgcaacaaacacacggcctactcttgtcacccgggccggccaataagcacggaagaggcaaggcctcagaccctggacagacatcctccctccagaggcacccagggcctcagccttctcctccctccctggcctcaatttctccacctgtgacccagggcaggtggatccagggagaagaaccttctggctccatctcaccgtgggtcctgccagcacacacaaagatttggcctctcaaagcctagctctgccagcgtccttctgctcaagaactctccatgactcccagtggccctaaggacaaagtcctggcatttgaggccctcccaatgcagggccagactctgcctctccagcttcctgtccccaccacacccctgctgtctcacggtggtccgactgtttcctgcttctgttgctttgcttagtctggcaccctgctggcatgctttctcacccttcttccccaatcccaactcacccagtctttcaaagggcaggctaaataccaggcctccaggtggcccaggattcttctctgagctttcatgggcctggccctgggtgctacctgtgagtagtcccacggtgggtacatagtaggtgcgcttactgtttgcaagaatgaacatgggacagtttggggactgtcacccagctcagggagcactgatggggaagcatctcctgtatgtcccagggctcagtgctgtagtgtcctgaccctcagaaatctcataatggcttggtcaggaaggcatcgtgccccactttgcaaacagggggtgctgagaattgaggggccttgtccaaggtctcatggctaggagcaagcagaatcggatttgaacccagggccacgtgacttcagaagtgccattaaagtccccataatttggagctgtcttctttttttttttcttttctttttttttgagaccgagcctcactctgtcacctaggccaggagtgcagtggtctgatctcagctcactgcaacctccgcctcctaggttcaagtgattctctagcctcagcctcccaagtagctgggactacaggcgcacgtcatcatgcccagctaacttttgtatttttagtagagatgggttttcaccatgttggtcaggctggtctcgaactcctgacctcaagtgatccgtctgcctcggcctctcaaagtgctgggattataaggcttgagccactacactcggcctggagctgtgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagcccggccccctgaaagttcccctcggtgggctgttagggtgattgttttcatctgtggggctcctgatgcgtcccacccaccagccttggagagggtgggatgggagggtggggtgcttggggagacaagcctagagcctgggcctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgaccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgtatcctgagctcacgcccagcagagccatccttggggctctggagggtcaccaaccctcccagtttgctggaactaaatggttatgcaggactttcagtgttgaaagaaagcctcgggcaaactgggctgactctttcactttaaccctggtctctggcgtctgctcacccagctg

SEQ ID NO: 211 - protein, 22 aa, Homo sapiens
MDRGTLPLAVALLLASCSLSPT

SEQ ID NO: 212 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 213 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 214 - DNA, 3080 bp, Homo sapiens
cactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattaaa

SEQ ID NO: 215 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 216 - protein, 5 aa, Artificial sequence
  Synthetic sequence: Heavy chain CDR1
DNYMH

SEQ ID NO: 217 - protein, 17 aa, Artificial sequence
  Synthetic sequence: Heavy chain CDR2
WIDPENGDTEYAPKFRG

SEQ ID NO: 218 - protein, 11 aa, Artificial sequence
  Synthetic sequence: Heavy chain CDR3
LIYAGYLAMDY

SEQ ID NO: 219 - protein, 10 aa, Artificial sequence
  Synthetic sequence: Light chain CDR1
SASSSVTYMH

SEQ ID NO: 220 - protein, 7 aa, Artificial sequence
  Synthetic sequence: Light chain CDR2
STSNLAS

SEQ ID NO: 221 - protein, 9 aa, Artificial sequence
  Synthetic sequence: Light chain CDR3
QQRSTYPLT

SEQ ID NO: 222 - protein, 11 aa, Artificial sequence
  Synthetic sequence: Light chain CDR1
KASQDVGTSVA

SEQ ID NO: 223 - protein, 7 aa, Artificial sequence
  Synthetic sequence: Light chain CDR2
WTSTRHT

SEQ ID NO: 224 - protein, 8 aa, Artificial sequence
  Synthetic sequence: Light chain CDR3
QQYSLYRS

SEQ ID NO: 225 - protein, 5 aa, Artificial sequence
  Synthetic sequence: Heavy chain CDR1
TYWMS

SEQ ID NO: 226 - protein, 17 aa, Artificial sequence
  Synthetic sequence: Heavy chain CDR2
EIHPDSSTINYAPSLKD

SEQ ID NO: 227 - protein, 10 aa, Artificial sequence
  Synthetic sequence: Heavy chain CDR3
LYFGFPWFAY

SEQ ID NO: 228 - protein, 15 aa, Artificial sequence
  Synthetic sequence: Light chain CDR1
KASQSVDYDGDSYLN

SEQ ID NO: 229 - protein, 7 aa, Artificial sequence
  Synthetic sequence: Light chain CDR2
DASNLVS

SEQ ID NO: 230 - protein, 9 aa, Artificial sequence
  Synthetic sequence: Light chain CDR3
QQSTEDPWT

SEQ ID NO: 231 - protein, 5 aa, Artificial sequence
  Synthetic sequence: Heavy chain CDR1
SYWMN

SEQ ID NO: 232 - protein, 17 aa, Artificial sequence
  Synthetic sequence: Heavy chain CDR2
QIWPGDGDTNYNGKFKG

SEQ ID NO: 233 - protein, 15 aa, Artificial sequence
  Synthetic sequence: Heavy chain CDR3
RETTTVGRYYYAMDY

---

The invention claimed is:

1. A compound of formula III:

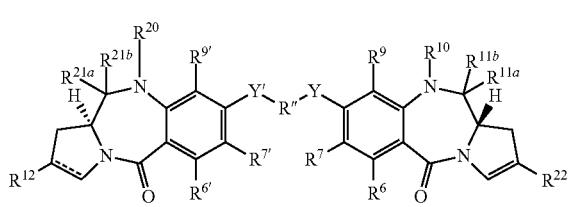

III or a pharmaceutically acceptable salt thereof, wherein:

$R^{22}$ is selected from:

(a) formula IVa:

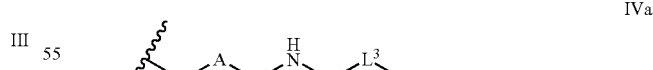

IVa where A is a phenyl group, and either (i) $Q^1$ is a single bond, and $Q^2$ is selected from a single bond and —Z—$(CH_2)_n$—, where Z is selected from a single bond, O, S and NH and n is from 1 to 3; or (ii) $Q^1$ is —CH=CH—, and $Q^2$ is a single bond;

(b) formula IVb:

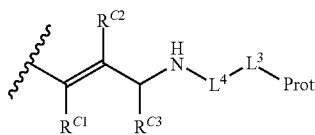

where $R^{C1}$, $R^{C2}$ and $R^{C3}$ are independently selected from H and unsubstituted $C_{1-2}$ alkyl;

(c) formula IVc:

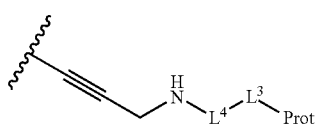

where Q is selected from OH, SH and $NR^N$, and $R^N$ is selected from H, methyl and ethyl X is selected from the group consisting of: OH, SH, $CO_2H$, COH, N=C=O, $NHNH_2$, $CONHNH_2$,

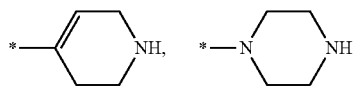 [SMILES: *C1=CCNCC1 ; *N1CCNCC1]

and $NHR^N$, wherein $R^N$ is selected from the group consisting of H and $C_{1-4}$ alkyl;

$L^4$ is selected from a single bond and a group of:

(a)

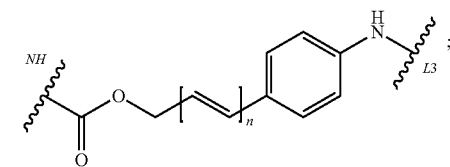

wherein n is 0 to 3;

(b)

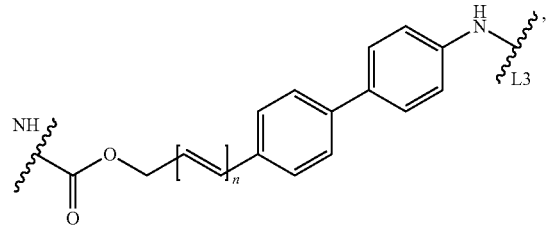

wherein n is as defined above;

(c)

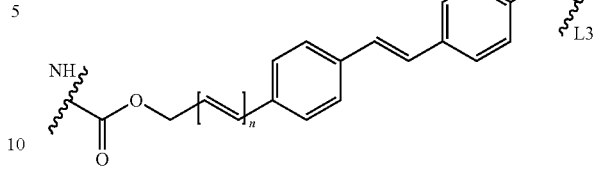

wherein n is as defined above; and (d)

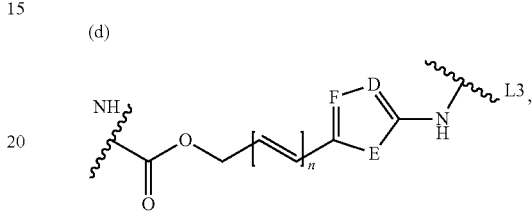

wherein n is as defined above, E is O, S or NR, D is N, CH, or CR, and F is N, CH, or CR;

L3 is:

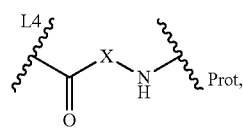

where X is such that L3 is an amino-acid residue, a dipeptide residue or a tripeptide residue;

Prot is selected from Fmoc (fluorenylmethyloxycarbonyl), Teoc (2-(trimethylsilyl)ethoxycarbonyl) and Boc (t-butoxycarbonyl);

$R^6$ and $R^9$ are independently selected from H, R, OH, OR, SH, SR, $NH_2$, NHR, NRR', nitro, $Me_3Sn$ and halo;

$R^7$ is selected from H, R, OH, OR, SH, SR, $NH_2$, NHR, NHRR', nitro, $Me_3Sn$ and halo;

$R^{6'}$, $R^{7'}$, $R^{9'}$ are selected from the same groups as $R^6$, $R^7$ and $R^9$ respectively;

when there is a double bond present between C2' and C3', $R^{12}$ is selected from the group consisting of:
  (ia) phenyl, naphthyl or azulenyl group or $C_{5-10}$ heteroaryl, optionally substituted by one or more substituents selected from the group consisting of: halo, nitro, cyano, $C_{1-7}$ alkoxy, $C_{3-20}$ heterocyclyloxy, $C_{5-20}$ aryloxy, carboxy, —C(=O)O$C_{1-7}$alkyl, —C(=O)O$C_{3-20}$heterocyclyl, —C(=O)O$C_{5-20}$aryl, $C_{1-7}$ alkyl, $C_{3-7}$ heterocyclyl; and bis-oxy-$C_{1-3}$ alkylene;
  (ib) $C_{1-5}$ saturated aliphatic alkyl;
  (ic) $C_{3-6}$ saturated cycloalkyl;

(id)

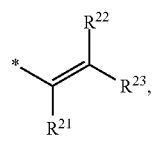

wherein each of $R^{21}$, $R^{22}$ and $R^{23}$ are independently selected from H, $C_{1-3}$ saturated alkyl, $C_{2-3}$ alkenyl, $C_{2-3}$ alkynyl and cyclopropyl, where the total number of carbon atoms in the $R^{12}$ group is no more than 5;

(ie)

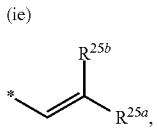

wherein one of $R^{25a}$ and $R^{25b}$ is H and the other is selected from: phenyl, which phenyl is optionally substituted by a group selected from halo, methyl, methoxy; pyridyl; and thiophenyl; and (if)

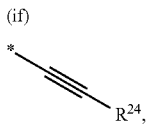

where $R^{24}$ is selected from: H; $C_{1-3}$ saturated alkyl; $C_{2-3}$ alkenyl; $C_{2-3}$ alkynyl; cyclopropyl; phenyl, which phenyl is optionally substituted by a group selected from halo, methyl, methoxy; pyridyl; and thiophenyl;
when there is a single bond present between C2' and C3', $R^{12}$ is H or

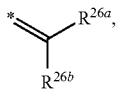

where $R^{26a}$ and $R^{26b}$ are independently selected form H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{26a}$ and $R^{26b}$ is H, the other is selected from nitrile and a $C_{1-4}$ alkyl ester;
R" is a $C_{3-12}$ alkylene group, which chain is interrupted by one or more aromatic rings selected from benzene or pyridine;
Y and Y' are selected from O, S, or NH;
either:
(A) $R^{20}$ is H or Me and $R^{21a}$ and $R^{21b}$ are both H or together form =O and either:
(i) $R^{10}$ is H, $R^{11a}$ is H and $R^{11b}$ is OH or $OR^A$, where $R^A$ is $C_{1-4}$ alkyl; or
(ii) $R^{10}$ and $R^{11b}$ form a nitrogen-carbon double bond between the nitrogen and carbon atoms to which they are bound and $R^{11a}$ is H; or
(iii) $R^{10}$ is H, $R^{11a}$ is H and $R^{11b}$ is $SO_zM$, where z is 2 or 3 and M is a monovalent pharmaceutically acceptable cation; or
(B) $R^{10}$ is H or Me and $R^{11a}$ and $R^{11b}$ are both H or together form =O and either:
(i) $R^{20}$ is H, $R^{21a}$ is H and $R^{21b}$ is OH or $OR^A$, where $R^A$ is $C_{1-4}$ alkyl; or
(ii) $R^{20}$ and $R^{21b}$ form a nitrogen-carbon double bond between the nitrogen and carbon atoms to which they are bound and $R^{11a}$ is H; or
(iii) $R^{20}$ is H, $R^{21a}$ is H and $R^{21b}$ is $SO_zM$, where z is 2 or 3 and M is a monovalent pharmaceutically acceptable cation;
wherein the $C_{3-20}$ heterocyclyloxy group and —C(=O)$OC_{3-20}$heterocyclyl group independently contain 1 to 10 ring heteroatoms selected from N, O and S;
the $C_{3-7}$ heterocyclyl group contains 1 to 4 ring heteroatoms selected from N, O and S.

2. A Conjugate having formula V:

$$L-(LU-D)_p \quad (V)$$

wherein L is an antibody or antibody fragment,
LU is a Linker unit,
p is 1 to 20; and
D is a Drug unit which is a PBD dimer according to formula I:

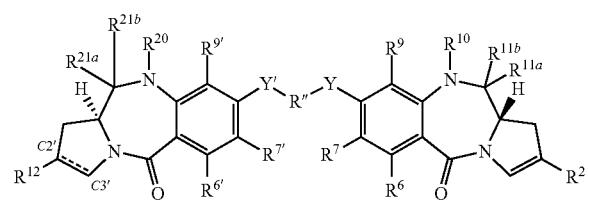

or a pharmaceutically acceptable salt thereof,
wherein:
$R^2$ is of formula IIa, formula IIb or formula IIc:

(a)

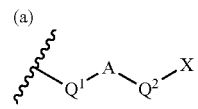

where A is a phenyl group, and either
(i) $Q^1$ is a single bond, and $Q^2$ is selected from a single bond and —Z—(CH$_2$)$_n$—, where Z is selected from a single bond, O, S and NH and n is from 1 to 3; or
(ii) $Q^1$ is —CH=CH—, and $Q^2$ is a single bond;

(b)

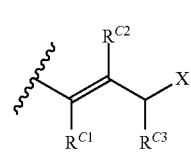

where;
$R^{C1}$, $R^{C2}$ and $R^{C3}$ are independently selected from H and unsubstituted $C_{1-2}$ alkyl;

(c)

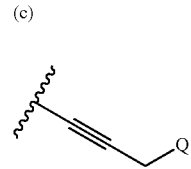

where Q is selected from OH, SH and NR$^N$, and R$^N$ is selected from H, methyl and ethyl X is selected from the group consisting of: OH, SH, CO$_2$H, COH, N=C=O, NHNH$_2$, CONHNH$_2$,

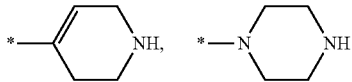 [SMILES: *C1=CCNCC1 ; *N1CCNCC1]

and NHR$^N$, wherein R$^N$ is selected from the group consisting of H and C$_{1-4}$ alkyl;

and either:

when there is a double bond present between C2' and C3', R$^{12}$ is selected from the group consisting of:

(ia) phenyl, naphthyl or azulenyl group or C$_{5-10}$ heteroaryl, optionally substituted by one or more substituents selected from the group consisting of: halo, nitro, cyano, C$_{1-7}$ alkoxy, C$_{3-20}$ heterocyclyloxy, C$_{5-20}$ aryloxy, carboxy, —C(=O)OC$_{1-7}$alkyl, —C(=)OC$_{3-20}$heterocycyl, —C(=O)OC$_{5-20}$aryl, C$_{1-7}$ alkyl, C$_{3-7}$ heterocyclyl; and bis-oxy-C$_{1-3}$ alkylene;

(ib) C$_{1-5}$ saturated aliphatic alkyl;

(ic) C$_{3-6}$ saturated cycloalkyl;

(id)

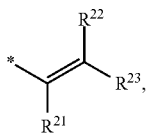

wherein each of R$^{21}$, R$^{22}$ and R$^{23}$ are independently selected from H, C$_{1-3}$ saturated alkyl, C$_{2-3}$ alkenyl, C$_{2-3}$ alkynyl, and cyclopropyl, where the total number of carbon atoms in the R$^{12}$ group is no more than 5;

(ie)

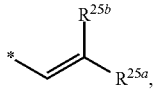

wherein one of R$^{25a}$ and R$^{25b}$ is H and the other is selected from: phenyl, which phenyl is optionally substituted by a group selected from halo, methyl, methoxy; pyridyl; and thiophenyl; and (if)

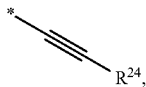

where R$^{24}$ is selected from: H; C$_{1-3}$ saturated alkyl; C$_{2-3}$ alkenyl; C$_{2-3}$ alkynyl; cyclopropyl; phenyl, which phenyl is optionally substituted by a group selected from halo, methyl, methoxy; pyridyl; and thiophenyl;

when there is a single bond present between C2' and C3', R$^{12}$ is H or

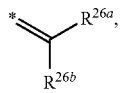

where R$^{26a}$ and R$^{26b}$ are independently selected from H, F, C$_{1-4}$ saturated alkyl, C$_{2-3}$ alkenyl, which alkyl and alkenyl groups are optionally substituted by a group selected from C$_{1-4}$ alkyl amido and C$_{1-4}$ alkyl ester; or, when one of R$^{26a}$ and R$^{26b}$ is H, the other is selected from nitrile and a C$_{1-4}$ alkyl ester;

R$^6$ and R$^9$ are independently selected from H, R, OH, OR, SH, SR, NH$_2$, NHR, NRR', nitro, Me$_3$Sn and halo;

where R and R' are independently selected from optionally substituted C$_{1-12}$ alkyl, C$_{3-20}$ heterocyclyl with 1 to 10 ring heteroatoms selected from N, O, and S, and C$_{5-20}$ aryl groups;

R$^7$ is selected from H, R, OH, OR, SH, SR, NH$_2$, NHR, NHRR', nitro, Me$_3$Sn and halo;

R" is a C$_{3-12}$ alkylene group, which chain is interrupted by one or more aromatic rings selected from benzene or pyridine;

Y and Y' are selected from O, S, or NH;

R$^{6'}$, R$^{7'}$, R$^{9'}$ are selected from the same groups as R$^6$, R$^7$ and R$^9$ respectively;

either:

(A) R$^{20}$ is H or Me and R$^{21a}$ and R$^{21b}$ are both H or together form =O and either:
  (i) R$^{10}$ is H, R$^{11a}$ is H and R$^{11b}$ is OH or OR$^A$, where R$^A$ is C$_{1-4}$ alkyl; or
  (ii) R$^{10}$ and R$^{11b}$ form a nitrogen-carbon double bond between the nitrogen and carbon atoms to which they are bound and R$^{11a}$ is H; or
  (iii) R$^{10}$ is H, R$^{11a}$ is H and R$^{11b}$ is SO$_z$M, where z is 2 or 3 and M is a monovalent pharmaceutically acceptable cation; or (B) R$^{10}$ is H or Me and R$^{11a}$ and R$^{11b}$ are both H or together form =O and either:
  (i) R$^{20}$ is H, R$^{21a}$ is H and R$^{21b}$ is OH or OR$^A$, where R$^A$ is C$_{1-4}$ alkyl; or
  (ii) R$^{20}$ and R$^{21b}$ form a nitrogen-carbon double bond between the nitrogen and carbon atoms to which they are bound and R$^{11a}$ is H; or
  (iii) R$^{20}$ is H, R$^{21a}$ is H and R$^{21b}$ is SO$_z$M, where z is 2 or 3 and M is a monovalent pharmaceutically acceptable cation;

wherein LU is connected to D via the X substituent of R$^2$ wherein the Linker unit (LU) has the formula (Va):

$$-A^1-L^3-L^4-, \qquad (Va)$$

wherein:

-A$^1$- is a Stretcher unit, p is from 1-20;

L$^4$ is selected from a single bond and a group of:

(a)

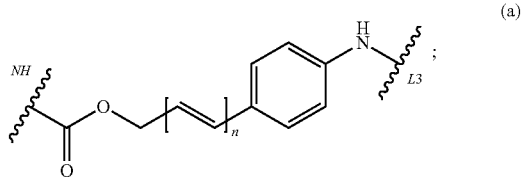

wherein n is 0 to 3;

(b)

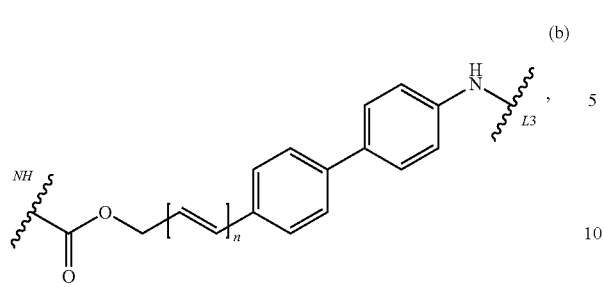

wherein n is as defined above;

(c)

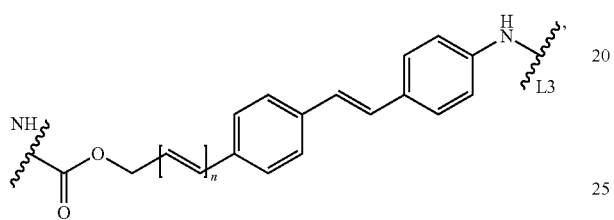

wherein n is as defined above; and (d)

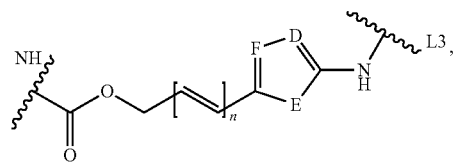

wherein n is as defined above, E is O, S or NR, D is N, CH, or CR, and F is N, CH, or CR;

$L^3$ is:

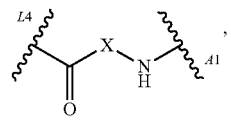

where X is such that $L^3$ is an amino-acid residue, a dipeptide residue or a tripeptide residue;

wherein -$A^1$- is selected from

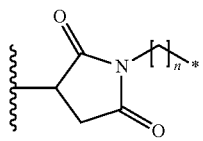

where the asterisk indicates the point of attachment to $L^3$, the wavy line indicates the point of attachment to the Ligand unit, and n is 0 to 6;

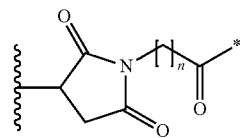

where the asterisk indicates the point of attachment to $L^3$, the wavy line indicates the point of attachment to the Ligand unit, and n is 0 to 6;

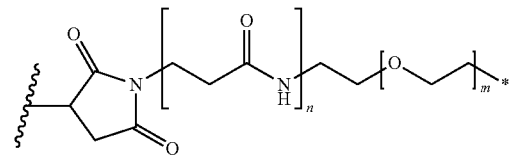

where the asterisk indicates the point of attachment to $L^3$, the wavy line indicates the point of attachment to the Ligand unit, n is 0 or 1, and m is 0 to 30; or

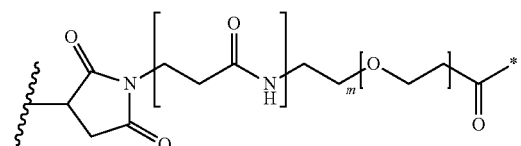

where the asterisk indicates the point of attachment to $L^3$, the wavy line indicates the point of attachment to the Ligand unit, n is 0 or 1, and m is 0 to 30;

wherein the $C_{3-20}$ heterocyclyloxy group and —C(=O) $OC_{3-20}$heterocyclyl group independently contain 1 to 10 ring heteroatoms selected from N, O and S;

the $C_{3-7}$ heterocyclyl group contains 1 to 4 ring heteroatoms selected from N, O and S.

3. The Conjugate of claim 2, wherein the Linker unit (LU) has formula (Va), $L^3$ is a dipeptide, $L^4$ is a single bond, and wherein $A^1$ is selected from:

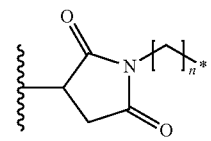

where the asterisk indicates the point of attachment to $L^3$, the wavy line indicates the point of attachment to the Ligand unit, and n is 0 to 6;

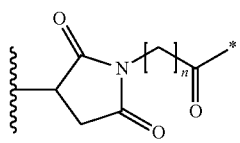

where the asterisk indicates the point of attachment to $L^3$, the wavy line indicates the point of attachment to the Ligand unit, and n is 0 to 6;

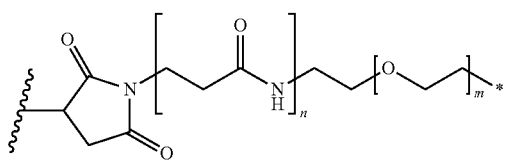

where the asterisk indicates the point of attachment to L³, the wavy line indicates the point of attachment to the Ligand unit, n is 0 or 1, and m is 0 to 30; or

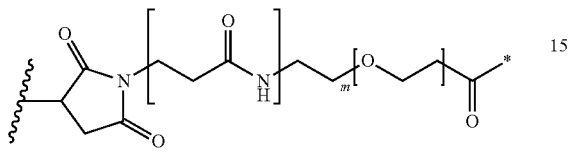

where the asterisk indicates the point of attachment to L³, the wavy line indicates the point of attachment to the Ligand unit, n is 0 or 1, and m is 0 to 30.

4. A drug linker of formula VI:

LU-D (VI)

or a pharmaceutically acceptable salt thereof, wherein LU is a Linker unit and where D is a Drug unit which is a PBD dimer according to formula I:

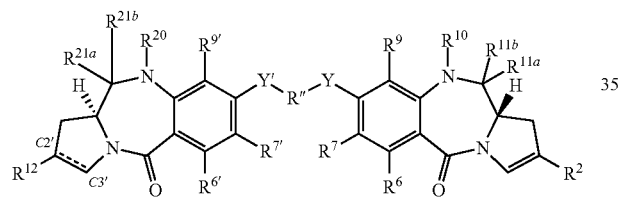

I wherein:
R² is of formula IIa, formula IIb or formula IIc:

(a)

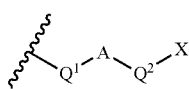

IIa where A is a phenyl group, and either
(i) Q¹ is a single bond, and Q² is selected from a single bond and —Z—(CH₂)ₙ—, where Z is selected from a single bond O, S and NH and n is from 1 to 3; or
(ii) Q¹ is —CH=CH—, and Q² is a single bond;

(b)

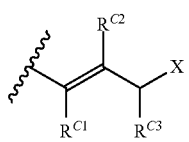

IIb where;
$R^{C1}$, $R^{C2}$ and $R^{C3}$ are independently selected from H and unsubstituted $C_{1-2}$ alkyl;
where X is selected from *—O—$^q$, *—S—$^q$, *—CO₂—$^q$, *—CO—$^q$, *—NH(C=O)—$^q$, *—NHNH—$^q$, *—CONHNH—$^q$,

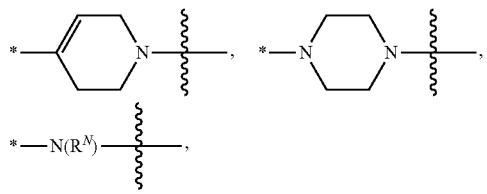

*—N($R^N$)—$\xi$—, wherein $R^N$ is selected from the group consisting of H and $C_{1-4}$ alkyl, and the asterix indicates the point of attachment to the remainder of the Drug unit and the wavy line or $^q$ indicates the point of attachment to the Linker Unit;
and either:
when there is a double bond present between C2' and C3', R¹² is selected from the group consisting of:
(ia) phenyl, naphthyl or azulenyl group or $C_{5-10}$ heteroaryl, optionally substituted by one or more substituents selected from the group consisting of: halo, nitro, cyano, $C_{1-7}$ alkoxy, $C_{3-20}$ heterocyclyloxy, $C_{5-20}$ aryloxy, carboxy, —C(=O)O$C_{1-7}$alkyl, —C(=O)O$C_{3-20}$heterocyclyl, —C(=O)O$C_{5-20}$aryl, $C_{1-7}$ alkyl, $C_{3-7}$ heterocyclyl; and bis-oxy-$C_{1-3}$ alkylene;
(ib) $C_{1-5}$ saturated aliphatic alkyl;
(ic) $C_{3-6}$ saturated cycloalkyl;

(id)

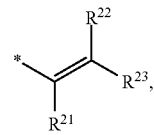

wherein each of R²¹, R²² and R²³ are independently selected from H, $C_{1-3}$ saturated alkyl, $C_{2-3}$ alkenyl, $C_{2-3}$ alkynyl and cyclopropyl, where the total number of carbon atoms in the R¹² group is no more than 5;

(ie)

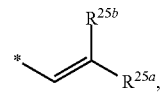

wherein one of $R^{25a}$ and $R^{25b}$ is H and the other is selected from: phenyl, which phenyl is optionally substituted by a group selected from halo, methyl, methoxy; pyridyl; and thiophenyl; and (if)

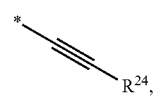

where $R^{24}$ is selected from: H; $C_{1-3}$ saturated alkyl; $C_{2-3}$ alkenyl; $C_{2-3}$ alkynyl; cyclopropyl; phenyl, which is phenyl is optionally substituted by a group selected from halo, methyl, methoxy; pyridyl; and thiophenyl;

when there is a single bond present between C2' and C3', $R^{12}$ is H or

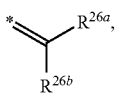

where $R^{26a}$ and $R^{26b}$ are independently selected from H, F, $C_{1-4}$ saturated alkyl, $C_{2-3}$ alkenyl, which alkyl and alkenyl groups are optionally substituted by a group selected from $C_{1-4}$ alkyl amido and $C_{1-4}$ alkyl ester; or, when one of $R^{26a}$ and $R^{26b}$ is H, the other is selected from nitrile and a $C_{1-4}$ alkyl ester;

$R^6$ and $R^9$ are independently selected from H, R, OH, OR, SH, SR, $NH_2$, NHR, NRR', nitro, $Me_3Sn$ and halo; wherein R and R' are independently selected from optionally substituted $C_{1-12}$ alkyl, $C_{3-20}$ heterocyclyl with 1 to 10 ring heteroatoms selected from N, O and S and $C_{5-20}$ aryl groups;

$R^7$ is selected from H, R, OH, OR, SH, SR, $NH_2$, NHR, NHRR', nitro $Me_3Sn$ and halo;

R" is a $C_{3-12}$ alkylene group, which chain is interrupted by one or more aromatic rings selected from benzene or pyridine;

Y and Y' are selected from O, S, or NH;

$R^{6'}$, $R^{7'}$, $R^{9'}$ are selected from the same groups as $R^6$, $R^7$, and $R^9$ respectively;

either:
(A) $R^{20}$ is H or Me and $R^{21a}$ and $R^{21b}$ are both H or together form =O and either:
  (i) $R^{10}$ is H, $R^{11a}$ is H and $R^{11b}$ is OH or $OR^A$, where $R^A$ is $C_{1-4}$ alkyl; or
  (ii) $R^{10}$ and $R^{11b}$ form a nitrogen-carbon double bond between the nitrogen and carbon atoms to which they are bound and $R^{11a}$ is H; or
  (iii) $R^{10}$ is H, $R^{11a}$ is H and $R^{11b}$ is $SO_zM$, where z is 2 or 3 and M is a monovalent pharmaceutically acceptable cation; or
(B) $R^{10}$ is H or Me and $R^{11a}$ and $R^{11b}$ are both H or together form =O and either:
  (i) $R^{20}$ is H, $R^{21a}$ is H and $R^{21b}$ is OH or $OR^A$, where $R^A$ is $C_{1-4}$ alkyl; or
  (ii) $R^{20}$ and $R^{21b}$ form a nitrogen-carbon double bond between the nitrogen and carbon atoms to which they are bound and $R^{11a}$ is H; or
  (iii) $R^{20}$ is H, $R^{21a}$ is H and $R^{21b}$ is $SO_zM$, where z is 2 or 3 and M is a monovalent pharmaceutically acceptable cation;

wherein the $C_{3-20}$ heterocyclyloxy group and —C(=O)$OC_{3-20}$heterocyclyl group independently contain 1 to 10 ring heteroatoms selected from N, O and S;

the $C_{3-7}$ heterocyclyl group contains 1 to 4 ring heteroatoms selected from N, O and S;

wherein the Linker unit (LU) has the formula (Va):

$G^1$-$L^3$-$L^4$-,  (Va)

wherein:
-$G^1$- is a Stretcher unit,
p is from 1-20;

$L^4$ is selected from a single bond and a group of:

(a)
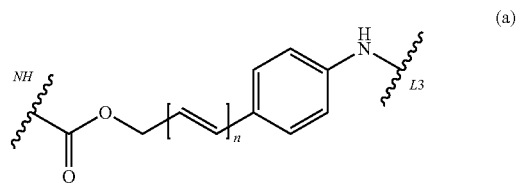

wherein n is 0 to 3;

(b)
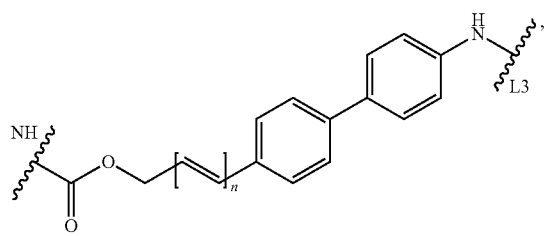

wherein n is as defined above;

(c)
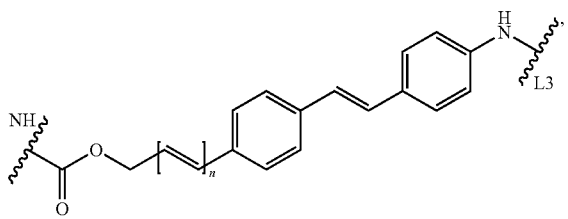

wherein n is as defined above; and (d)
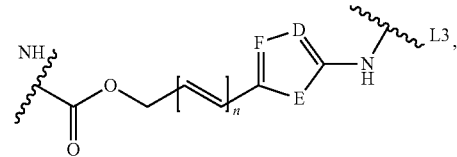

wherein n is as defined above E is O, S or NR, D is N, CH, or CR, and F is N, CH, or CR;

$L^3$ is:

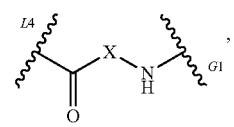

where X is such that $L^3$ is an amino-acid residue, a dipeptide residue or a tripeptide residue;

wherein -$G^1$- is selected from where the asterisk indicates the point of attachment to $L^3$ and n is 0 to 6;

where the asterisk indicates the point of attachment to $L^3$ and n is 0 to 6;

where the asterisk indicates the point of attachment to $L^3$, n is 0 or 1, and m is 0 to 30; or where the asterisk indicates the point of attachment to $L^3$, n is 0 or 1 and m is 0 to 30.

5. A conjugate according to claim 2, wherein $R^7$ is a $C_{1-4}$ alkyloxy group.

6. A conjugate according to claim 2, wherein Y is O and R" is $C_{3-7}$ alkylene which chain is interrupted by one or more aromatic rings selected from benzene or pyridine.

7. A conjugate according to claim 2, wherein $R^6$ and $R^9$ are H.

8. A conjugate according to claim 2, wherein there is a double bond between C2' and C3', and $R^{12}$ is:
(a) a $C_{5-7}$ aryl group, which may bear one to three substituent groups selected from methoxy, ethoxy, fluoro, chloro, cyano, bis-oxy-methylene, methyl-piperazinyl, morpholino and methyl-thiophenyl; or
(b) methyl, ethyl or propyl; or
(c) cyclopropyl; or
(d) a group of formula:

wherein the total number of carbon atoms in the $R^{12}$ group is no more than 4; or
(e) the group:

or
(f) a group of formula:

wherein $R^{24}$ is selected from H and methyl.

9. A conjugate according to claim 2, wherein there is a single bond between C2' and C3', $R^{12}$ is and:
(a) $R^{26a}$ and $R^{26b}$ are both H; or
(b) $R^{26a}$ and $R^{26b}$ are both methyl; or
(c) one of $R^{26a}$ and $R^{26b}$ is H, and the other is selected from $C_{1-4}$ saturated alkyl, $C_{2-3}$ alkenyl, which alkyl and alkenyl groups are optionally substituted.

10. A conjugate according to claim 2, wherein $R^2$ is of formula IIa, and A is phenyl, $Q^1$ is a single bond, and $Q^2$ is a single bond.

11. A compound according to claim 2, wherein $R^2$ is of formula IIb, and $R^{C1}$, $R^{C2}$ and $R^{C3}$ are all H.

12. A conjugate according to claim 10, wherein X is $NH_2$.

13. A conjugate according to claim 2, wherein $R^2$ is of formula IIc, and Q is $NR^N$, wherein $R^N$ is H or methyl.

14. A conjugate according to claim 2, wherein $R^{6'}$, $R^{7'}$, $R^{9'}$ and Y' are the same as $R^6$, $R^7$, $R^9$, and Y respectively.

15. A conjugate according to claim 2, wherein $R^{20}$ is H or Me and $R^{21a}$ and $R^{21b}$ are both H.

16. A conjugate according to claim 2, wherein $R^{20}$ is H or Me and $R^{21a}$ and $R^{21b}$ together form =O.

17. A conjugate according to claim 15, wherein $R^{10}$ and $R^{11b}$ form a nitrogen-carbon double bond between the nitrogen and carbon atoms to which they are bound and $R^{11a}$ is H.

18. A conjugate according to claim 2, wherein $R^{10}$ is H or Me and $R^{11a}$ and $R^{11b}$ are both H.

19. A conjugate according to claim 2, wherein $R^{10}$ is H or Me and $R^{11a}$ and $R^{11b}$ together form =O.

20. A conjugate according to claim 18, wherein $R^{20}$ and $R^{21b}$ form a nitrogen-carbon double bond between the nitrogen and carbon atoms to which they are bound and $R^{11a}$ is H.

* * * * *